US011667687B2

(12) United States Patent
Mitra et al.

(10) Patent No.: US 11,667,687 B2
(45) Date of Patent: Jun. 6, 2023

(54) MASKED ACTIVATABLE INTERFERON CONSTRUCTS

(71) Applicant: CytomX Therapeutics, Inc., South San Francisco, CA (US)

(72) Inventors: Sayantan Mitra, Mountain View, CA (US); Nicole G. Lapuyade, San Francisco, CA (US); Hikmat Haizar Assi, San Pablo, CA (US); Madan M. Paidhungat, San Francisco, CA (US); Dylan L. Daniel, San Francisco, CA (US); Erwan Le Scolan, San Francisco, CA (US); Walter A. Bogdanoff, Rio Vista, CA (US); Na Cai, San Mateo, CA (US); Hsin Wang, San Mateo, CA (US); Alexey Yevgenyevich Berezhnoy, Burlingame, CA (US)

(73) Assignee: CytomX Therapeutics, Inc., South San Francisco, CA (US)

( * ) Notice: Subject to any disclaimer, the term of this patent is extended or adjusted under 35 U.S.C. 154(b) by 0 days.

(21) Appl. No.: 17/696,222

(22) Filed: Mar. 16, 2022

(65) Prior Publication Data

US 2022/0306717 A1    Sep. 29, 2022

Related U.S. Application Data

(60) Provisional application No. 63/276,893, filed on Nov. 8, 2021, provisional application No. 63/254,748, filed on Oct. 12, 2021, provisional application No. 63/164,827, filed on Mar. 23, 2021, provisional application No. 63/161,913, filed on Mar. 16, 2021.

(51) Int. Cl.
*C07K 14/56* (2006.01)
*C07K 14/565* (2006.01)
*C07K 14/57* (2006.01)

(52) U.S. Cl.
CPC ............ *C07K 14/56* (2013.01); *C07K 14/565* (2013.01); *C07K 14/57* (2013.01); *C07K 2319/30* (2013.01); *C07K 2319/50* (2013.01); *C07K 2319/70* (2013.01)

(58) Field of Classification Search
CPC .............. C07K 14/555; C07K 2319/50; C07K 2319/00
See application file for complete search history.

(56) References Cited

U.S. PATENT DOCUMENTS

| 5,030,719 | A | 7/1991 | Umemeto et al. |
|---|---|---|---|
| 5,731,168 | A | 3/1998 | Carter et al. |
| 7,465,790 | B2 | 12/2008 | Waldmann et al. |
| 7,695,936 | B2 | 4/2010 | Carter et al. |
| 8,399,219 | B2 | 3/2013 | Stagliano et al. |
| 8,513,390 | B2 | 8/2013 | Stagliano et al. |
| 8,518,404 | B2 | 8/2013 | Daugherty et al. |
| 8,529,898 | B2 | 9/2013 | Daugherty et al. |
| 8,541,203 | B2 | 9/2013 | Daugherty et al. |
| 8,563,269 | B2 | 10/2013 | Stagliano et al. |
| 8,734,774 | B2 | 5/2014 | Frelinger et al. |
| 8,809,504 | B2 | 8/2014 | Lauermann |
| 8,993,266 | B2 | 3/2015 | Stagliano et al. |
| 9,169,321 | B2 | 10/2015 | Daugherty et al. |
| 9,453,078 | B2 | 9/2016 | Stagliano et al. |
| 9,644,016 | B2 | 5/2017 | Stagliano et al. |
| 9,675,672 | B2 | 6/2017 | Tagaya |
| 10,059,762 | B2 | 8/2018 | Stagliano et al. |
| 10,077,300 | B2 | 8/2018 | Daugherty et al. |
| 10,118,961 | B2 | 11/2018 | Stagliano et al. |
| 10,513,549 | B2 | 12/2019 | Stagliano et al. |
| 10,683,368 | B2 | 6/2020 | Moessner et al. |
| 10,696,723 | B2 | 6/2020 | Winston et al. |
| 10,696,724 | B2 | 6/2020 | Winston et al. |
| 10,875,913 | B2 | 12/2020 | Stagliano et al. |
| 11,028,162 | B2 | 6/2021 | Daugherty et al. |
| 11,136,353 | B2 | 10/2021 | Stover et al. |
| 11,365,233 | B2 | 6/2022 | Mitra et al. |

(Continued)

FOREIGN PATENT DOCUMENTS

| EP | 1523503 | 4/2009 |
|---|---|---|
| EP | 1324771 | 6/2011 |

(Continued)

OTHER PUBLICATIONS

Irving, "Probodies Empower a New Generation of Antibody Immunotherapies," presented at Keystone Symposia on Molecular and Cellular Biology, Feb. 2015, 25 pages.
La Rocca et al., "Zymographic Detection and Clinical Correlations of MMP-2 and MMP-9 in Breast Cancer sera", Br. J. Cancer (2004) 90(7): 1414-1421.
Ramakrishnan et al.,"Comparison of the Selective Cytotoxic Effects of Immunotoxins Containing Ricin A Chain or Pokeweed Antiviral Protein and Anti-Thy 1.1 Monoclonal Antibodies", Cancer Res. (1984) 44:201-208.
Vitetta et al., "Redesigning Nature's Poisons to Create Anti-Tumor Reagents", Science (1987) 238:1098.

(Continued)

*Primary Examiner* — Elly-Gerald Stoica
(74) *Attorney, Agent, or Firm* — Rothwell, Figg, Ernst & Manbeck, P.C.

(57) ABSTRACT

Provided herein are activatable cytokine constructs that include: (a) a first monomer construct comprising a first peptide mask (PM1), a third cleavable moiety (CM3), a first mature cytokine protein (CP1), a first cleavable moiety (CM1), and a first dimerization domain (DD1), wherein the CM1 is positioned between the CP1 and the DD1, and the CM3 is positioned between the PM1 and CP1; and (b) a second monomer construct comprising a second mature cytokine protein (CP2), a second cleavable moiety (CM2), and a second dimerization domain (DD2), where the CM2 is positioned between the CP2 and the DD2, where: the DD1 and the DD2 bind each other; and where the ACC is characterized by a reduction in at least one activity of the CP1 and/or CP2 as compared to a control level of the at least one activity of the CP1 and/or CP2.

30 Claims, 68 Drawing Sheets

Specification includes a Sequence Listing.

(56) References Cited

U.S. PATENT DOCUMENTS

| | | |
|---|---|---|
| 2004/0109855 A1 | 6/2004 | Waldmann et al. |
| 2006/0024272 A1 | 2/2006 | Reinl et al. |
| 2006/0269516 A1 | 11/2006 | Presta et al. |
| 2009/0025106 A1 | 1/2009 | Reinl et al. |
| 2009/0304719 A1 | 12/2009 | Daugherty et al. |
| 2010/0189651 A1 | 7/2010 | Stagliano et al. |
| 2010/0297081 A1 | 11/2010 | Huang et al. |
| 2012/0149061 A1 | 6/2012 | Stagliano et al. |
| 2012/0207756 A1 | 8/2012 | Stagliano et al. |
| 2012/0237512 A1 | 9/2012 | Daugherty et al. |
| 2012/0244154 A1 | 9/2012 | Daugherty et al. |
| 2013/0309230 A1 | 11/2013 | Stagliano et al. |
| 2014/0024810 A1 | 1/2014 | Stagliano et al. |
| 2014/0045195 A1 | 2/2014 | Daugherty et al. |
| 2016/0122425 A1 | 5/2016 | Daugherty et al. |
| 2016/0228546 A1 | 8/2016 | Stagliano et al. |
| 2016/0289324 A1 | 10/2016 | Moore et al. |
| 2017/0051015 A1 | 2/2017 | Tagaya et al. |
| 2017/0081397 A1 | 3/2017 | Stagliano et al. |
| 2019/0119370 A1 | 4/2019 | Stagliano et al. |
| 2019/0211089 A1 | 7/2019 | Daugherty et al. |
| 2019/0216898 A1 | 7/2019 | Wang et al. |
| 2019/0284283 A1 | 9/2019 | Moore et al. |
| 2019/0315883 A1 | 10/2019 | Ast et al. |
| 2020/0040052 A1 | 2/2020 | Winston et al. |
| 2020/0283490 A1 | 9/2020 | Winston et al. |
| 2020/0392235 A1 | 12/2020 | Lu et al. |
| 2021/0002343 A1 | 1/2021 | Karow et al. |
| 2021/0115102 A1 | 4/2021 | Winston et al. |
| 2021/0130430 A1 | 5/2021 | Winston et al. |
| 2021/0139553 A1 | 5/2021 | Li et al. |
| 2021/0187027 A1 | 6/2021 | Wu et al. |
| 2021/0188934 A1 | 6/2021 | Wu et al. |
| 2021/0237977 A1 | 8/2021 | Lindley et al. |

FOREIGN PATENT DOCUMENTS

| | | |
|---|---|---|
| WO | 1994011026 | 5/1994 |
| WO | 200191798 | 6/2001 |
| WO | 02/02143 A2 | 1/2002 |
| WO | 2002030460 A2 | 4/2002 |
| WO | 02/055098 A2 | 7/2002 |
| WO | 2004009638 A1 | 1/2004 |
| WO | 2007105027 | 9/2007 |
| WO | 2009025846 A2 | 2/2009 |
| WO | 2010081173 | 7/2010 |
| WO | 2010096838 A2 | 8/2010 |
| WO | 2012072815 A1 | 6/2012 |
| WO | 2015048329 | 4/2015 |
| WO | 2015116933 | 8/2015 |
| WO | 2015/198072 A1 | 12/2015 |
| WO | 2015198072 | 12/2015 |
| WO | 2017190684 A1 | 11/2017 |
| WO | 2018/071919 A1 | 4/2018 |
| WO | 2018/236701 A1 | 12/2018 |
| WO | 2018236701 A1 | 12/2018 |
| WO | 2019075405 A1 | 4/2019 |
| WO | 2019091384 A1 | 5/2019 |
| WO | 2019092181 A1 | 5/2019 |
| WO | 2019126240 A1 | 7/2019 |
| WO | 2019173832 A2 | 9/2019 |
| WO | 2019222294 A1 | 11/2019 |
| WO | 2019222295 A2 | 11/2019 |
| WO | 2019222296 A1 | 11/2019 |
| WO | 2019/246392 A1 | 12/2019 |
| WO | 2019230868 A1 | 12/2019 |
| WO | 2019246392 A1 | 12/2019 |
| WO | 2020/023702 A1 | 1/2020 |
| WO | 2020023702 A1 | 1/2020 |
| WO | 2020/041758 A1 | 2/2020 |
| WO | 2020041758 A1 | 2/2020 |
| WO | 2020065096 A1 | 4/2020 |
| WO | 2020069398 A1 | 4/2020 |
| WO | 2020086758 A1 | 4/2020 |
| WO | 2020113403 A1 | 6/2020 |
| WO | 2020118109 | 6/2020 |
| WO | 2020123980 A1 | 8/2020 |
| WO | 2020214690 A1 | 10/2020 |
| WO | 2020232305 A1 | 11/2020 |
| WO | 2020242884 | 12/2020 |
| WO | 2020246567 A1 | 12/2020 |
| WO | 2020252264 A1 | 12/2020 |
| WO | 2021011353 A1 | 1/2021 |
| WO | 2021016599 A1 | 1/2021 |
| WO | 2021016640 A1 | 1/2021 |
| WO | 2021/030483 A1 | 2/2021 |
| WO | 2021/035188 A1 | 2/2021 |
| WO | 2021/062406 A1 | 4/2021 |
| WO | 2021097376 A1 | 5/2021 |
| WO | 2021/113577 A1 | 6/2021 |
| WO | 2021/127487 A2 | 6/2021 |
| WO | 2021113577 A1 | 6/2021 |
| WO | 2021119516 A1 | 6/2021 |
| WO | 2021127487 A2 | 6/2021 |
| WO | 2021127495 A1 | 6/2021 |
| WO | 2021/146455 A1 | 7/2021 |
| WO | 2021/189139 A1 | 9/2021 |
| WO | 2021/202354 A1 | 10/2021 |
| WO | 2021/202673 A2 | 10/2021 |
| WO | 2021/202675 A1 | 10/2021 |
| WO | 2021/202678 A1 | 10/2021 |
| WO | 2021202678 A1 | 10/2021 |
| WO | 2021207669 A1 | 10/2021 |
| WO | 2021/222762 A2 | 11/2021 |
| WO | 2021/236676 A1 | 11/2021 |

OTHER PUBLICATIONS

Akbar, A. N., Lord, J. M. and Salmon, M. (2000) 'IFN-α and IFN-β: A link between immune memory and chronic inflammation', Immunology Today, 21(7), pp. 337-342. doi: 10.1016/S0167-5699(00)01652-2.

Altrock, B. W. et al. (1986) 'Antiviral and Antitumor Effects of a Human Interferon Analog, IFN-αCon1, Assessed in Hamsters', Journal of Interferon Research, 6(4), pp. 405-415. doi: 10.1089/jir.1986.6.405.

Altschul, S. F. et al. (1990) 'Basic local alignment search tool', Journal of Molecular Biology, 215(3), pp. 403-410. doi: 10.1016/S0022-2836(05)80360-2.

Arenas-Ramirez, N. et al. (2016) 'Improved cancer immunotherapy by a CD25-mimobody conferring selectivity to human interleukin-2', Science Translational Medicine, 8(367), pp. 1-13. doi: 10.1126/scitranslmed.aag3187.

Arndt, B. et al. (2015) 'CD8+CD122+PD-1—effector cells promote the development of diabetes in NOD mice', Journal of Leukocyte Biology, 97(1), pp. 111-120. doi: 10.1189/jlb.3a0613-344rr.

Atkins, M. B. et al. (2018) 'Pembrolizumab plus pegylated interferon alfa-2b or ipilimumab for advanced melanoma or renal cell carcinoma: dose-finding results from the phase Ib KEYNOTE-029 Study', Clinical Cancer Research, 24(8), pp. 1805-1815. doi: 10.1158/1078-0432.CCR-17-3436.

Bacher, N. et al. (2011) 'Interferon-α abrogates tolerance induction by human tolerogenic dendritic cells', PLoS ONE, 6(7). doi: 10.1371/journal.pone.0022763.

Bacher, N. et al. (2013) 'Interferon-a suppresses cAMP to disarm human regulatory T cells', Cancer Research, 73(18), pp. 5647-5656. doi: 10.1158/0008-5472.CAN-12-3788.

Baechler, E. C. et al. (2003) 'Interferon-inducible gene expression signature in peripheral blood cells of patients with severe lupus', Proceedings of the National Academy of Sciences of the United States of America, 100(5), pp. 2610-2615. doi: 10.1073/pnas.0337679100.

Bekisz, J. et al. (2004) 'Human interferons alpha, beta and omega', Growth Factors, 22(4), pp. 243-251. doi: 10.1080/08977190400000833.

Belardelli, F. et al. (1998) 'The induction of in vivo proliferation of long-lived CD44(hi) CD8+ T cells after the injection of tumor cells expressing IFN-α1 into syngeneic mice', Cancer Research, 58(24), pp. 5795-5802.

(56) References Cited

OTHER PUBLICATIONS

Benci, J. L. et al. (2016) 'Tumor Interferon Signaling Regulates a Multigenic Resistance Program to Immune Checkpoint Blockade', Cell, 167(6), pp. 1540-1554.e12. doi: 10.1016/j.cell.2016.11.022.

Benci, J. L. et al. (2019) 'Opposing Functions of Interferon Coordinate Adaptive and Innate Immune Responses to Cancer Immune Checkpoint Blockade', Cell, 178(4), pp. 933-948.e14. doi: 10.1016/j.cell.2019.07.019.

Boorjian, S. A. et al. (2021) 'Intravesical nadofaragene firadenovec gene therapy for BCG-unresponsive non-muscle-invasive bladder cancer: a single-arm, open-label, repeat-dose clinical trial', The Lancet Oncology, 22(1), pp. 107-117. doi: 10.1016/S1470-2045(20)30540-4.

Borden, E. C. (2019) 'Interferons α and β in cancer: therapeutic opportunities from new insights', Nature Reviews Drug Discovery, 18(3), pp. 219-234. doi: 10.1038/s41573-018-0011-2.

Bossen, C. et al. (2006) 'Interactions of tumor necrosis factor (TNF) and TNF receptor family members in the mouse and human', Journal of Biological Chemistry, 281(20), p. 13964-13971. doi: 10.1074/jbc.M601553200.

Brierley, M. M. and Fish, E. N. (2002) 'IFN-α/β receptor interactions to biologic outcomes: Understanding the circuitry', Journal of Interferon and Cytokine Research, 22(8), pp. 835-845. doi: 10.1089/107999002760274845.

Brosjö, O. et al. (1985) 'Influence of Human α-lnterferon on Four Human Osteosarcoma Xenografts in Nude Mice', Cancer Research, 45(Nov.), pp. 5598-5602.

Bruno, R. et al. (2012) 'Comparison of peginterferon pharmacokinetic and pharmacodynamic profiles', Journal of Viral Hepatitis, 19(SUPPL. 1), pp. 33-36. doi: 10.1111/j.1365-2893.2011.01519.x.

Budhwani, M., Mazzieri, R. and Dolcetti, R. (2018) 'Plasticity of type I interferon-mediated responses in cancer therapy: From antitumor immunity to resistance', Frontiers in Oncology, 8(Aug.). doi: 10.3389/fonc.2018.00322.

Burnette, B. C. et al. (2011) 'The efficacy of radiotherapy relies upon induction of type I interferon-dependent innate and adaptive immunity', Cancer Research, 71(7), pp. 2488-2496. doi: 10.1158/0008-5472.CAN-10-2820.

Cameron, R. B., McIntosh, J. K. and Rosenberg, S. A. (1988) 'Synergistic antitumor effects of combination immunotherapy with recombinant interleukin-2 and a recombinant hybrid α-interferon in the treatment of established murine hepatic metastases', Cancer Research, 48(20), pp. 5810-5817.

Carmenate, T. et al. (2013) 'Human IL-2 Mutein with Higher Antitumor Efficacy Than Wild Type IL-2', The Journal of Immunology, 190(12), pp. 6230-6238. doi: 10.4049/jimmunol.1201895.

Cheetham, B. F. et al. (1991) 'Structure-function studies of human interferons-α: Enhanced activity on human and murine cells', Antiviral Research, 15(1), pp. 27-39. doi: 10.1016/0166-3542(91)90038-S.

Chen, J., Baig, E. and Fish, E. N. (2004) 'Diversity and relatedness among the type I interferons', Journal of Interferon and Cytokine Research, 24(12), pp. 687-698. doi: 10.1089/jir.2004.24.687.

Chen, W. et al. (2017) Establishing a safe, rapid, convenient and low-cost antiviral assay of interferon bioactivity based on recombinant VSV expressing GFP, Journal of Virological Methods. Elsevier B.V. doi: 10.1016/j.jviromet.2017.08.007.

Da Silva, A. J. et al. (2002) 'Comparison of gene expression patterns induced by treatment of human umbilical vein endothelial cells with IFN-α2b vs. IFN-β1a: Understanding the functional relationship between distinct type I interferons that act through a common receptor', Journal of Interferon and Cytokine Research, 22(2), pp. 173-188. doi: 10.1089/107999002753536149.

Daud, A. et al. (2012) 'Management of pegylated interferon alpha toxicity in adjuvant therapy of melanoma', Expert Opinion on Biological Therapy, 12(8), pp. 1087-1099. doi: 10.1517/14712598.2012.694421.

Daud, A. I. et al. (2011) 'Pharmacokinetic/pharmacodynamic analysis of adjuvant pegylated interferon α-2b in patients with resected high-risk melanoma', Cancer Chemotherapy and Pharmacology, 67(3), pp. 657-666. doi: 10.1007/s00280-010-1326-9.

Davar, D. et al. (2018) 'Phase Ib/II study of pembrolizumab and pegylated-interferon alfa-2b in advanced melanoma', Journal of Clinical Oncology, 36(35), pp. 3450-3458. doi: 10.1200/JCO.18.00632.

De Paula, V. S. et al. (2020) 'Interleukin-2 druggability is modulated by global conformational transitions controlled by a helical capping switch', Proceedings of the National Academy of Sciences of the United States of America, 117(13), pp. 7183-7192. doi: 10.1073/pnas.2000419117.

De Weerd, N. A. et al. (2013) 'Structural basis of a unique interferon-β signaling axis mediated via the receptor IFNAR1', Nature Immunology, 14(9), pp. 901-907. doi: 10.1038/ni.2667.

De Weerd, N. A., Samarajiwa, S. A. and Hertzog, P. J. (2007) 'Type I interferon receptors: Biochemistry and biological functions', Journal of Biological Chemistry, 282(28), pp. 20053-20057. doi: 10.1074/jbc.R700006200.

Demers, G. W. et al. (2002) 'Tumor growth inhibition by interferon-α using PEGylated protein or adenovirus gene transfer with constitutive or regulated expression', Molecular Therapy, 6(1), pp. 50-56. doi: 10.1006/mthe.2002.0629.

Diamond, M. S. et al. (2011) 'Type I interferon is selectively required by dendritic cells for immune rejection of tumors', Journal of Experimental Medicine, 208(10), pp. 1989-2003. doi: 10.1084/jem.20101158.

Doctoral_Thesis_Kuen_Martin "Antibody masked cytokines as new approach in targeted tumor therapy" (2015).

Dubrot, J. et al. (2011) 'Intratumoral injection of interferon-α and systemic delivery of agonist anti-CD137 monoclonal antibodies synergize for immunotherapy', International Journal of Cancer, 128(1), pp. 105-118. doi: 10.1002/ijc.25333.

Dunn, G. P. et al. (2005) 'A critical function for type I interferons in cancer immunoediting', Nature Immunology, 6(7), pp. 722-729. doi: 10.1038/ni1213.

Eggermont, A. M. M. et al. (2012) 'Long-term results of the randomized phase III trial EORTC 18991 of adjuvant therapy with pegylated interferon alfa-2b versus observation in resected stage III melanoma', Journal of Clinical Oncology, 30(31), pp. 3810-3818. doi: 10.1200/JCO.2011.41.3799.

Elsadek, B. and Kratz, F. (2012) 'Impact of albumin on drug delivery—New applications on the horizon', Journal of Controlled Release, 157(1), pp. 4-28. doi: 10.1016/j.jconrel.2011.09.069.

Escudier, B. et al. (2010) 'Phase III trial of bevacizumab plus interferon alfa-2a in patients with metastatic renal cell carcinoma (AVOREN): Final analysis of overall survival', Journal of Clinical Oncology, 28(13), pp. 2144-2150. doi: 10.1200/JCO.2009.26.7849.

Faries, M. B. (2016) 'Intralesional immunotherapy for metastatic melanoma: The oldest and newest treatment in oncology', Critical Reviews in Oncogenesis, 21(1-2), pp. 65-73. doi: 10.1615/CritRevOncog.2016017124.

Ferrantini, M., Capone, I. and Belardelli, F. (2007) 'Interferon-α and cancer: Mechanisms of action and new perspectives of clinical use', Biochimie, 89(6-7), pp. 884-893. doi: 10.1016/j.biochi.2007.04.006.

Fitzgerald-Bocarsly, P. (2007) 'The role of type I interferon production by dendritic cells in host defense', Biochimie, 89, pp. 843-855. doi: 10.1016/j.biochi.2007.04.018.

Flores, M. V. et al. (2012) 'Preclinical studies of PF-04849285, an interferon-α8 fusion protein for the treatment of HCV', Antiviral Therapy, 17(5), pp. 869-881. doi: 10.3851/IMP2099.

Foster, G. R. and Finter, N. B. (1998) 'Are all Type I human interferons equivalent?', Journal of Viral Hepatitis, 5(3), pp. 143-152. doi: 10.1046/j.1365-2893.1998.00103.x.

Foster, G. R. et al. (2004) 'IFN-α Subtypes Differentially Affect Human T Cell Motility', The Journal of Immunology, 173(3), pp. 1663-1670. doi: 10.4049/jimmunol.173.3.1663.

Fuertes, M. B. et al. (2011) 'Host type I IFN signals are required for antitumor CD8+ T cell responses through CD8α+ dendritic cells', Journal of Experimental Medicine, 208(10), pp. 2005-2016. doi: 10.1084/jem.20101159.

(56) References Cited

OTHER PUBLICATIONS

Fuertes, M. B. et al. (2013) 'Type I interferon response and innate immune sensing of cancer', Trends in Immunology, 34(2), pp. 67-73. doi: 10.1016/j.it.2012.10.004.

Fujimura, T. et al. (2017) 'Phase I study of nivolumab combined with IFN-β for patients with advanced melanoma', Oncotarget, 8(41), pp. 71181-71187. doi: 10.18632/oncotarget.17090.

Furse, R. K. and Malek, T. R. (1993) 'Selection of internalization-deficient cells by interleukin-2-Pseudomonas exotoxin chimeric protein: the cytoplasmic domain of the interleukin-2 receptor β chain does not contribute to internalization of interleukin-2', European Journal of Immunology, 23(12), pp. 3181-3188. doi: 10.1002/eji.1830231221.

Ghaffar, A. et al. (1992) 'Cross-Species Antiviral Activity of a Recombinant Human Alpha-Interferon Hybrid', Annals of the New York Academy of Sciences, 653(1), pp. 314-322. doi: 10.1111/j.1749-6632.1992.tb19658.x.

Glue, P. et al. (2000) 'Pegylated interferon-α2b: Pharmacokinetics, pharmacodynamics, safety, and preliminary efficacy data', Clinical Pharmacology and Therapeutics, 68(5), pp. 556-567. doi: 10.1067/mcp.2000.110973.

Gogas, H. Ioannovich, J., Dafni, U., Stavropoulou-Giokas, C., Frangia, K., Tsoutsos, D., Panagiotou, P., Polyzos, A., Papadopoulos, O., Stratigos, A., Markopoulos, C., Bafaloukos, D., Pectasides, D., Fountzilas, G., & Kirkwood, J. M. (2006) 'Prognostic Significance of Autoimmunity during Treatment of Melanoma with Interferon', N Engl J Med, pp. 709-718.

Grace, M. et al. (2001) 'Structural and biologic characterization of pegylated recombinant IFN-β2b', Journal of Interferon and Cytokine Research, 21(12), pp. 1103-1115. doi: 10.1089/107999001317205240.

Grace, M. J. et al. (2005) 'Site of pegylation and polyethylene glycol molecule size attenuate interferon-α antiviral and antiproliferative activities through the JAK/STAT signaling pathway', Journal of Biological Chemistry, 280(8), pp. 6327-6336. doi: 10.1074/jbc.M412134200.

Gresser, I. (1989) 'Antitumor effects of interferon', Acta Oncologica, 28(3), pp. 347-353. doi: 10.3109/02841868909111205.

Grob, J. J. et al. (2013) 'Adjuvant therapy with pegylated interferon alfa-2b (36 months) versus low-dose interferon alfa-2b (18 months) in melanoma patients without macrometastatic nodes: An open-label, randomised, phase 3 European Association for Dermato-Oncology (EADO) study', European Journal of Cancer, 49(1), pp. 166-174. doi: 10.1016/j.ejca.2012.07.018.

Gui, J. et al. (2016) 'Therapeutic Elimination of the Type 1 Interferon Receptor for Treating Psoriatic Skin Inflammation', Journal of Investigative Dermatology, 136(10), pp. 1990-2002. doi: 10.1016/j.jid.2016.06.608.

Guo, J. et al. (2019) 'Empowering therapeutic antibodies with IFN-α for cancer immunotherapy', PLoS ONE, 14(8), pp. 1-13. doi: 10.1371/journal.pone.0219829.

Gutterman, J. U. (1994) 'Cytokine therapeutics: Lessons from interferon α', Proceedings of the National Academy of Sciences of the United States of America, 91(4), pp. 1198-1205. doi: 10.1073/pnas.91.4.1198.

Hagiwara, S. et al. (2007) 'Combination therapy with PEG-IFN-α and 5-FU inhibits HepG2 tumour cell growth in nude mice by apoptosis of p53', British Journal of Cancer, 97(11), pp. 1532-1537. doi: 10.1038/sj.bjc.6604058.

Harari, D. et al. (2014) 'Bridging the species divide: Transgenic mice humanized for type-I interferon response', PLoS ONE, 9(1), pp. 1-12. doi: 10.1371/journal.pone.0084259.

Harcourt, J. L. and Offermann, M. K. (2000) 'Interferon-α synergistically enhances induction of interleukin-6 by double stranded RNA in HeLa cells', European Journal of Biochemistry, 267(9), pp. 2768-2777. doi: 10.1046/j.1432-1327.2000.01300.x.

Harris, K. E. et al. (2021) 'A bispecific antibody agonist of the IL-2 heterodimeric receptor preferentially promotes in vivo expansion of CD8 and NK cells', Scientific Reports, 11(1), pp. 1-15. doi: 10.1038/s41598-021-90096-8.

Hashimoto, H. et al. (2014) 'Type i IFN gene delivery suppresses regulatory T cells within tumors', Cancer Gene Therapy, 21(12), pp. 532-541. doi: 10.1038/cgt.2014.60.

Hervas-Stubbs, S. et al. (2011) 'Direct effects of type I interferons on cells of the immune system', Clinical Cancer Research, 17(9), pp. 2619-2627. doi: 10.1158/1078-0432.CCR-10-1114.

Herzer, K. et al. (2009) 'IFN-α-induced apoptosis in hepatocellular carcinoma involves promyelocytic leukemia protein and TRAIL independently of p53', Cancer Research, 69(3), pp. 855-862. doi: 10.1158/0008-5472.CAN-08-2831.

Hilkens, C. M. U., Schlaak, J. F. and Kerr, I. M. (2003) 'Differential Responses to IFN-α Subtypes in Human T Cells and Dendritic Cells', The Journal of Immunology, 171(10), pp. 5255-5263. doi: 10.4049/jimmunol.171.10.5255.

Huang, T.-H., Chintalacharuvu, K. R. and Morrison, S. L. (2007) 'Targeting IFN-α to B Cell Lymphoma by a Tumor-Specific Antibody Elicits Potent Antitumor Activities', The Journal of Immunology, 179(10), pp. 6881-6888. doi: 10.4049/jimmunol.179.10.6881.

Iigo, M. et al. (1988) 'In Vivo Antitumor Activity of Multiple Injections of Recombinant Interleukin 2, Â §', Cancer Research, 48(2), pp. 260-264.

INFERGEN (Interferon alfacon-1) Label_copyright 1997-1998.

Isaacs A, L. J. (1957) 'Virus interference . I . The interferon', Proc R Soc Lond B Biol Sci, 147(927), pp. 258-267.

Islam, M. et al. (2002) 'Differential effect of IFNα-2b on the cytochrome P450 enzyme system: A potential basis of IFN toxicity and its modulation by other drugs', Clinical Cancer Research, 8(8), pp. 2480-2487.

Ito, N. et al. (1996) 'Induction of interleukin-6 by interferon alfa and its abrogation by a serine protease inhibitor in patients with chronic hepatitis C', Hepatology, 23(4), pp. 669-675. doi: 10.1053/jhep.1996.v23.pm0008666316.

Ivashkiv, L. B. and Donlin, L. T. (2014) 'Regulation of type i interferon responses', Nature Reviews Immunology, 14(1), pp. 36-49. doi: 10.1038/nri3581.

Jablonska, J. et al. (2010) 'Neutrophils responsive to endogenous IFN-β regulate tumor angiogenesis and growth in a mouse tumor model', Journal of Clinical Investigation, 120(4), pp. 1151-1164. doi: 10.1172/JCI37223.

Jacquelot, N. et al. (2019) 'Sustained Type I interferon signaling as a mechanism of resistance to PD-1 blockade', Cell Research, 29(10), pp. 846-861. doi: 10.1038/s41422-019-0224-x.

Jaitin, D. A. et al. (2006) 'Inquiring into the Differential Action of Interferons (IFNs): an IFN-α2 Mutant with Enhanced Affinity to IFNAR1 is Functionally Similar to IFN-β', Molecular and Cellular Biology, 26(5), pp. 1888-1897. doi: 10.1128/mcb.26.5.1888-1897.2006.

Jeon, S. et al. (2013) 'Saturable human neopterin response to interferon-α assessed by a pharmacokinetic-pharmacodynamic model', Journal of Translational Medicine, 11(1), p. 1. doi: 10.1186/1479-5876-11-240.

Jia, H. et al. (2016) 'Elimination of N-glycosylation by site mutation further prolongs the half-life of IFN-α/Fc fusion proteins expressed in Pichia pastoris', Microbial Cell Factories, 15(1), pp. 1-9. doi: 10.1186/s12934-016-0601-9.

Jones, T. D. et al. (2004) 'The Development of a Modified Human IFN-α2b Linked to the Fc Portion of Human IgG1 as a Novel Potential Therapeutic for the Treatment of Hepatitis C Virus Infection', Journal of Interferon & Cytokine Research, 24(9), pp. 560-572. doi: 10.1089/1079990041992686.

Kalie, E. et al. (2007) 'An interferon α2 mutant optimized by phage display for IFNAR1 binding confers specifically enhanced antitumor activities', Journal of Biological Chemistry, 282(15), pp. 11602-11611. doi: 10.1074/jbc.M610115200.

Kang, J. H., Bluestone, J. A. and Young, A. (2021) 'Predicting and Preventing Immune Checkpoint Inhibitor Toxicity: Targeting Cytokines', Trends in Immunology, 42(4), pp. 293-311. doi: 10.1016/j.it.2021.02.006.

Klatte, T. et al. (2008) 'Pretreatment with interferon-α2a modulates perioperative immunodysfunction in patients with renal cell carcinoma', Onkologie, 31(1-2), pp. 28-34. doi: 10.1159/000112214.

Koltchev, D. H. et al. (2008) 'Biological activities and detection of cynomolgus interferon-α subtypes', PBL InterferonSource Poster.

(56) References Cited

OTHER PUBLICATIONS

Kono, T., Minami, Y. and Taniguchi, T. (1993) 'The interleukin-2 receptor complex and signal transduction: Role of the β-chain', Seminars in Immunology, pp. 299-307. doi: 10.1006/smim.1993.1036.

Kotredes, K. P. and Gamero, A. M. (2013) 'Interferons as inducers of apoptosis in malignant cells', Journal of Interferon and Cytokine Research, 33(4), pp. 162-170. doi: 10.1089/jir.2012.0110.

Krepler, C. et al. (2004) 'Pegylated and conventional interferon-α induce comparable transcriptional responses and inhibition of tumor growth in a human melanoma SCID mouse xenotransplantation model', Journal of Investigative Dermatology, 123(4), pp. 664-669. doi: 10.1111/j.0022-202X.2004.23433.x.

Kuruganti, S., Accavitti-Loper, M. A. and Walter, M. R. (2017) 'Production and characterization of thirteen human Type-I interferon-α subtypes', Protein Expr Purif. Nov. 2014;103:75-83. doi: 10.1016/j.pep.2014.08.010.

Kusano, H. et al. (2013) 'Pegylated interferon-α2a inhibits proliferation of human liver cancer cells in vitro and in vivo', PLoS ONE, 8(12), pp. 1-10. doi: 10.1371/journal.pone.0083195.

Lazear, H. M., Schoggins, J. W. and Diamond, M. S. (2019) 'Shared and Distinct Functions of Type I and Type III Interferons', Immunity, 50(4), pp. 907-923. doi: 10.1016/j.immuni.2019.03.025.

Le Bon, A. et al. (2001) 'Type I interferons potently enhance humoral immunity and can promote isotype switching by stimulating dendritic cells in vivo', Immunity, 14(4), pp. 461-470. doi: 10.1016/S1074-7613(01)00126-1.

Leavy, O. (2011) 'Cytokines: Structuring the type I IFN response', Nature Reviews Immunology, 11(10), pp. 640-641. doi: 10.1038/nri3067.

Li, S. F. et al. (2018) 'Type i interferons: Distinct biological activities and current applications for viral infection', Cellular Physiology and Biochemistry, 51(5), pp. 2377-2396. doi: 10.1159/000495897.

Liang, Y. et al. (2018) 'Targeting IFNα to tumor by anti-PD-L1 creates feedforward antitumor responses to overcome checkpoint blockade resistance', Nature Communications, 9(1), pp. 1-11. doi: 10.1038/s41467-018-06890-y.

Liang, Y. et al. (2018) 'Targeting IFNα to tumor by anti-PD-L1 creates feedforward antitumor responses to overcome checkpoint blockade resistance', Nature Communications, 9(1), Supplements pp. 1-12.

Liu, H. et al. (2018) 'Tumor-derived IFN triggers chronic pathway agonism and sensitivity to ADAR loss', Nature Medicine, 25(1), pp. 95-102. doi: 10.1038/s41591-018-0302-5.

Liu, Y. Z. et al. (2012) 'Pegylated interferon α enhances recovery of memory T cells in e antigen positive chronic hepatitis B patients', Virology Journal, 9(1), p. 1. doi: 10.1186/1743-422X-9-274.

Loignon, M. et al. (2008) 'Stable high volumetric production of glycosylated human recombinant IFNalpha2b in HEK293 cells', BMC Biotechnology, 8, pp. 1-16. doi: 10.1186/1472-6750-8-65.

Lopes, J. E. et al. (2020) 'ALKS 4230: A novel engineered IL-2 fusion protein with an improved cellular selectivity profile for cancer immunotherapy', Journal for ImmunoTherapy of Cancer, 8(1), pp. 1-13. doi: 10.1136/jitc-2020-000673.

Malek, T. R. et al. (1998) 'Monoclonal antibodies to the common γ-chain as cytokine receptor antagonists in vivo: Effect on intrathymic and intestinal intraepithelial T lymphocyte development', Journal of Leukocyte Biology, 63(6), pp. 643-649. doi: 10.1002/jlb.63.6.643.

Marchant, D. J. et al. (2014) 'A new transcriptional role for matrix metalloproteinase-12 in antiviral immunity', Nature Medicine, 20(5), pp. 493-502. doi: 10.1038/nm.3508.

Martinović, K. M. et al. (2019) 'Effect of cytokines on NK cell activity and activating receptor expression in high-risk cutaneous melanoma patients', European Cytokine Network, 30(4), pp. 160-167. doi: 10.1684/ecn.2019.0440.

Massoud, R. et al. (2015) 'Common γ-chain blocking peptide reduces in vitro immune activation markers in HTLV-1-associated myelopathy/tropical spastic paraparesis', Proceedings of the National Academy of Sciences of the United States of America, 112(35), pp. 11030-11035. doi: 10.1073/pnas.1412626112.

Meager, A. (2002) 'Biological assays for interferons', Journal of Immunological Methods, 261(1-2), pp. 21-36. doi: 10.1016/S0022-1759(01)00570-1.

Meager, A. et al. (2001) 'Establishment of new and replacement World Health Organization International Biological Standards for human interferon alpha and omega', Journal of Immunological Methods, 257(1-2), pp. 17-33. doi: 10.1016/S0022-1759(01)00460-4.

Medrano, R. F. V. et al. (2017) Immunomodulatory and antitumor effects of type I interferons and their application in cancer therapy, Oncotarget. doi: 10.18632/oncotarget.19531.

Minn, A. J. and Wherry, E. J. (2016) 'Combination Cancer Therapies with Immune Checkpoint Blockade: Convergence on Interferon Signaling', Cell, 165(2), pp. 272-275. doi: 10.1016/j.cell.2016.03.031.

Moll, H. P. et al. (2011) 'The differential activity of interferon-α subtypes is consistent among distinct target genes and cell types', Cytokine, 53(1), pp. 52-59. doi: 10.1016/j.cyto.2010.09.006.

Moraga, I. et al. (2009) 'Receptor Density is Key to the Alpha2/Beta Interferon Differential Activities', Molecular and Cellular Biology, 29(17), pp. 4778-4787. doi: 10.1128/mcb.01808-08.

Moraga, I. et al. (2017) 'Synthekines are surrogate cytokine and growth factor agonists that compel signaling through non-natural receptor dimers', eLife, 6, pp. 1-22. doi: 10.7554/eLife.22882.

Moriya, F. et al. (2008) 'Growth inhibitory effects of pegylated IFN-α2b and 5-fluorouracil in combination on renal cell carcinoma cell lines in vitro and in vivo', International Journal of Oncology, 35, pp. 547-557. doi: 10.3892/ijo.

Mundy-bosse, B. L. and Young, G. S. (2012) 'cells from patients with GI malignancy', 60(9), pp. 1269-1279. doi: 10.1007/s00262-011-1029-z.Distinct.

Nakajima, S. et al. (1990) 'Changes in interferon receptors on peripheral blood mononuclear cells from patients with chronic hepatitis B being treated with interferon', Hepatology, 12(6), pp. 1261-1265. doi: 10.1002/hep.1840120602.

Nakamura, Y. et al. (1994) 'Heterodimerization of the IL-2 receptor β- and γ-chain cytoplasmic domains is required for signalling', Nature, 369(6478), pp. 330-333. doi: 10.1038/369330a0.

Nederman, T., Karlström, E. and Sjödin, L. (1990) 'An in vitro bioassay for quantitation of human interferons by measurements of antiproliferative activity on a continuous human lymphoma cell line', Biologicals, 18(1), pp. 29-34. doi: 10.1016/1045-1056(90)90066-9.

Nelson, B. H. et al. (1997) 'Requirement for an initial signal from the membrane-proximal region of the interleukin 2 receptor γc chain for Janus kinase activation leading to T cell proliferation', Proceedings of the National Academy of Sciences of the United States of America, 94(5), pp. 1878-1883. doi: 10.1073/pnas.94.5.1878.

Nelson, B. H., Lord, J. D. and Greenberg, P. D. (1994) 'signal for T-cell proliferation', Nature, 369(6478), pp. 333-336.

Nelson, B. H., Lord, J. D. and Greenberg, P. D. (1996) 'A membrane-proximal region of the interleukin-2 receptor gamma c chain sufficient for Jak kinase activation and induction of proliferation in T cells', Molecular and Cellular Biology, 16(1), pp. 309-317. doi: 10.1128/mcb.16.1.309.

Nuara, A. A. et al. (2008) 'Structure and mechanism of IFN-γ antagonism by an orthopoxvirus IFN-γ-binding protein', Proceedings of the National Academy of Sciences of the United States of America, 105(6), pp. 1861-1866. doi: 10.1073/pnas.0705753105.

O'Connell, P. et al. (2019) 'SLAMF7 is a Critical Negative Regulator of IFN-α-Mediated CXCL10 Production in Chronic HIV Infection', The Journal of Immunology, 202(1), pp. 228-238. doi: 10.4049/jimmunol.1800847.

O'Neil, J. et al. (2021) 'XTX202, a protein-engineered IL-2, in mice without peripheral toxicities in nonhuman primates.', ASCO Poster. doi: 10.1200/jco.2021.39.15_suppl.2563.

Ohdo, S. et al. (1997) 'Circadian rhythm of fever induced by interferon-alpha in mice', Life sciences, 61(8), pp. 95-100.

Okanoue, T. (2006) 'Side effects of interferon therapy for chronic hepatitis C', Nippon rinsho. Japanese journal of clinical medicine, 64(7), pp. 1363-1367.

(56) References Cited

OTHER PUBLICATIONS

Osborn, B. L. et al. (2002) 'Pharmacokinetic and pharmacodynamic studies of a human serum albumin-interferon-α fusion protein in cynomolgus monkeys', Journal of Pharmacology and Experimental Therapeutics, 303(2), pp. 540-548. doi: 10.1124/jpet.102.037002.

Ozzello, L. et al. (1988) 'Treatment of Human Breast Cancer Xenografts Using Natural Interferons-α and -γ Injected Singly or in Combination', Journal of Interferon Research, 8(5), pp. 679-690. doi: 10.1089/jir.1988.8.679.

Pace, L. et al. (2010) 'APC Activation by IFN-α Decreases Regulatory T Cell and Enhances Th Cell Functions', The Journal of Immunology, 184(11), pp. 5969-5979. doi: 10.4049/jimmunol.0900526.

Pan, M. et al. (2008) 'Mutation of the IFNAR-1 receptor binding site of human IFN-α2 generates type I IFN competitive antagonists', Biochemistry, 47(46), pp. 12018-12027. doi: 10.1021/bi801588g.

Parisi, G. et al. (2020) 'Persistence of adoptively transferred T cells with a kinetically engineered IL-2 receptor agonist', Nature Communications, 11(1), pp. 1-12. doi: 10.1038/s41467-019-12901-3.

Paulson, M. et al. (1999) 'Stat protein transactivation domains recruit p300/CBP through widely divergent sequences', Journal of Biological Chemistry, 274(36), pp. 25343-25349. doi: 10.1074/jbc.274.36.25343.

Pfeffer, L. M. et al. (1998) 'Biological Properties of Recombinant α-Interferons : 40th Anniversary of the Discovery of Interferons Biological Properties of Recombinant Â «-InterfÂ © rons : 40th Anniversary of the Discovery of Interferons1', Cancer Research, 58(12), pp. 2489-2499.

Piehler, J., Roisman, L. C. and Schreiber, G. (2000) 'New structural and functional aspects of the type I interferon-receptor interaction revealed by comprehensive mutational analysis of the binding interface', Journal of Biological Chemistry, 275(51), pp. 40425-40433. doi: 10.1074/jbc.M006854200.

Piehler, J., Thomas, C. and Garcia, K. C. (2012) 'Imr_12001 317 . . . 334', pp. 1-18. Available at: papers://1825b63a-f617-4840-9a49-fa78b8732348/Paper/p1187.

Platanias, L. C. (2005) 'Mechanisms of type-I- and type-II-interferon-mediated signalling', Nature Reviews Immunology, 5(5), pp. 375-386. doi: 10.1038/nri1604.

Plote, D. et al. (2019) 'Inhibition of urothelial carcinoma through targeted type I interferon-mediated immune activation', OncoImmunology, 8(5), pp. 1-17. doi: 10.1080/2162402X.2019.1577125.

Pogue, S. L. et al. (2016) 'Targeting attenuated interferon-α to myeloma cells with a CD38 antibody induces potent tumor regression with reduced off-target activity', PLoS ONE, 11(9), pp. 1-20. doi: 10.1371/journal.pone.0162472.

Price-Troska, T. et al. (2019) 'Inhibiting IL-2 signaling and the regulatory T-cell pathway using computationally designed peptides', Investigational New Drugs, 37(1), pp. 9-16. doi: 10.1007/s10637-018-0606-9.

Quadt-Akabayov, S. R. et al. (2006) 'Determination of the human type I interferon receptor binding site on human interferon-α2 by cross saturation and an NMR-based model of the complex', Protein Science, 15(11), pp. 2656-2668. doi: 10.1110/ps.062283006.

Radhakrishnan, R. et al. (1996) 'Zinc mediated dimer of human interferon-α(2b) revealed by X-ray crystallography', Structure, 4(12), pp. 1453-1463. doi: 10.1016/S0969-2126(96)00152-9.

Rath, P. C. and Aggarwal, B. B. (2001) 'Antiproliferative effects of IFN-α correlate with the downregulation of nuclear factor-κB in human Burkitt lymphoma Daudi cells', Journal of Interferon and Cytokine Research, 21(7), pp. 523-528. doi: 10.1089/10799900152434402.

Reading, J. L. and Quezada, S. A. (2016) 'Too Much of a Good Thing? Chronic IFN Fuels Resistance to Cancer Immunotherapy', Immunity, 45(6), pp. 1181-1183. doi: 10.1016/j.immuni.2016.12.004.

Reder, A. T. and Feng, X. (2014) 'How type i interferons work in multiple sclerosis and other diseases: Some unexpected mechanisms', Journal of Interferon and Cytokine Research, 34(8), pp. 589-599. doi: 10.1089/jir.2013.0158.

Rehberg, E. et al. (1982) 'Specific molecular activities of recombinant and hybrid leukocyte interferons', Journal of Biological Chemistry, 257(19), pp. 11497-11502. doi: 10.1016/s0021-9258(18)33788-8.

Richter, D. et al. (2017) 'Ligand-induced type II interleukin-4 receptor dimers are sustained by rapid re-association within plasma membrane microcompartments', Nature Communications, 8(May). doi: 10.1038/ncomms15976.

Rivero-Juarez, A. et al. (2017) 'KIR2DS2 as predictor of thrombocytopenia secondary to pegylated interferon-alpha therapy', Pharmacogenomics Journal, 17(4), pp. 360-365. doi: 10.1038/tpj.2016.19.

Roisman, L. C. et al. (2005) 'Mutational analysis of the IFNAR1 binding site on IFNα2 reveals the architecture of a weak ligand-receptor binding-site', Journal of Molecular Biology, 353(2), pp. 271-281. doi: 10.1016/j.jmb.2005.08.042.

Rossmann, C. et al. (1996) 'Expression and purification of recombinant, glycosylated human interferon alpha 2b in murine myeloma NSo cells', Protein Expression and Purification, 7(4), pp. 335-342. doi: 10.1006/prep.1996.0050.

Rozera, C. et al. (1999) 'Murine interferon-α1 gene-transduced ESb tumor cells are rejected by host-mediated mechanisms despite resistance of the parental tumor to interferon-α/α therapy', Cancer Gene Therapy, 6(3), pp. 246-253. doi: 10.1038/sj.cgt.7700051.

Runkel, L. et al. (2000) 'Systematic Mutational Mapping of Sites on Human Interferon-β-1a That Are Important for Receptor Binding and Functional Activity', Biochemistry, 39(10), pp. 2538-2551. Available at: http://pubs.acs.org/doi/abs/10.1021/bi991631c.

Ryan, C. W. et al. (2007) 'Sorafenib with interferon alfa-2b as first-line treatment of advanced renal carcinoma: A phase II study of the southwest oncology group', Journal of Clinical Oncology, 25(22), pp. 3296-3301. doi: 10.1200/JCO.2007.11.1047.

Samarajiwa, S. A. et al. (2009) 'INTERFEROME: The database of interferon regulated genes', Nucleic Acids Research, 37(SUPPL. 1), pp. 852-857. doi: 10.1093/nar/gkn732.

Sandler, N. G. et al. (2014) 'prevent SIV infection and slow disease progression', Nature, 511(7511), pp. 601-605. doi: 10.1038/nature13554.Type.

Santini, S. M. et al. (2000) 'Type I interferon as a powerful adjuvant for monocyte-derived dendritic cell development and activity in vitro and in Hu-PBL-SCID mice', Journal of Experimental Medicine, 191(10), pp. 1777-1788. doi: 10.1084/jem.191.10.1777.

Schlaak, J. F. et al. (2002) 'Cell-type and donor-specific transcriptional responses to interferon-α: Use of customized gene arrays', Journal of Biological Chemistry, 277(51), pp. 49428-49437. doi: 10.1074/jbc.M205571200.

Schreiber, G. (2017) 'The molecular basis for differential type i interferon signaling', Journal of Biological Chemistry, 292(18), pp. 7285-7294. doi: 10.1074/jbc.R116.774562.

Schreiber, G. and Piehler, J. (2015) 'The molecular basis for functional plasticity in type I interferon signaling', Trends in Immunology, 36(3), pp. 139-149. doi: 10.1016/j.it.2015.01.002.

Schwarzmeier, J. D. et al. (1996) 'Inadequate production of hematopoietic growth factors in hairy cell leukemia: Up-regulation of interleukin 6 by recombinant IFN-α in vitro', Cancer Research, 56(20), pp. 4679-4685.

Seeds, R. E. and Miller, J. L. (2011) 'Measurement of type I interferon production', Current Protocols in Immunology, (SUPPL. 92), pp. 1-11. doi: 10.1002/0471142735.im1421s92.

Sharma, M. et al. (2020) 'Bempegaldesleukin selectively depletes intratumoral Tregs and potentiates T cell-mediated cancer therapy', Nature Communications, 11(1). doi: 10.1038/s41467-020-14471-1.

Shire, S. J. (1983) 'pH-Dependent Polymerization of a Human Leukocyte Interferon Produced by Recombinant Deoxyribonucleic Acid Technology', Biochemistry, 22(11), pp. 2664-2671. doi: 10.1021/bi00280a012.

Siurala, M. et al. (2016) 'Syngeneic syrian hamster tumors feature tumor-infiltrating lymphocytes allowing adoptive cell therapy enhanced by oncolytic adenovirus in a replication permissive setting', OncoImmunology, 5(5). doi: 10.1080/2162402X.2015.1136046.

(56) References Cited

OTHER PUBLICATIONS

Slutzki, M. et al. (2006) 'Variations in the Unstructured C-terminal Tail of Interferons Contribute to Differential Receptor Binding and Biological Activity', Journal of Molecular Biology, 360(5), pp. 1019-1030. doi: 10.1016/j.jmb.2006.05.069.

Sonnenfeld, G. et al. (2001) 'Efficacy and safety of orally/sublingually, intranasally, and intraperitoneally administered recombinant murine interferon in the treatment of murine encephalomyocarditis virus', Journal of Interferon and Cytokine Research, 21(7), pp. 539-545. doi: 10.1089/10799900152434420.

Spangler, J. B. et al. (2015) 'Antibodies to Interleukin-2 Elicit Selective T Cell Subset Potentiation through Distinct Conformational Mechanisms', Immunity, 42(5), pp. 815-825. doi: 10.1016/j.immuni.2015.04.015.

Spangler, J. B. et al. (2019) 'A strategy for the selection of monovalent antibodies that span protein dimer interfaces', Journal of Biological Chemistry, 294(38), pp. 13876-13886. doi: 10.1074/jbc.RA119.009213.

Stagg, J. et al. (2011) 'Anti-ErbB-2 mAb therapy requires type I and II interferons and synergizes with anti-PD-1 or anti-CD137 mAb therapy', Proceedings of the National Academy of Sciences of the United States of America, 108(17), pp. 7142-7147. doi: 10.1073/pnas.1016569108.

Stauber, D. J. et al. (2006) 'Crystal structure of the IL-2 signaling complex: Paradigm for a heterotrimeric cytokine receptor', Proceedings of the National Academy of Sciences of the United States of America, 103(8), pp. 2788-2793. doi: 10.1073/pnas.0511161103.

Stetson, D. B. and Medzhitov, R. (2006) 'Type I Interferons in Host Defense', Immunity, 25(3), pp. 373-381. doi: 10.1016/j.immuni.2006.08.007.

Su, S. S. et al. (2014) 'Regulatory phenotype, PD-1 and TLR3 expression in T cells and monocytes from HCV patients undergoing antiviral therapy: A randomized clinical trial', PLoS ONE, 9(4). doi: 10.1371/journal.pone.0093620.

Subramanian, G. M. et al. (2007) 'Albinterferon α-2b: A genetic fusion protein for the treatment of chronic hepatitis C', Nature Biotechnology, 25(12), pp. 1411-1419. doi: 10.1038/nbt1364.

Sugyiama, K. et al. (1993) 'Expression of human interferon-α2 in Sf9 cells', European Journal of Biochemistry, 217(3), pp. 921-927. Available at: https://doi.org/10.1111/j.1432-1033.1993.tb18322.x.

Swann, J. B. et al. (2007) 'Type I IFN Contributes to NK Cell Homeostasis, Activation, and Antitumor Function', The Journal of Immunology, 178(12), pp. 7540-7549. doi: 10.4049/jimmunol.178.12.7540.

Talpaz, M. et al. (2013) 'Re-emergence of interferon-α in the treatment of chronic myeloid leukemia', Leukemia, 27(4), pp. 803-812. doi: 10.1038/leu.2012.313.

Tanaka, T. et al. (1991) 'A novel monoclonal antibody against murine IL-2 receptor beta-chain. Characterization of receptor expression in normal lymphoid cells and EL-4 cells.', Journal of immunology (Baltimore, Md. : 1950), 147(7), pp. 2222-2228. Available at: http://www.ncbi.nlm.nih.gov/pubmed/1918958.

Tanimoto, T. et al. (2007) 'The combination of IFN-α2 and IFN-α8 exhibits synergistic antiproliferative activity on renal cell carcinoma (RCC) cell lines through increased binding affinity for IFNAR-2', Journal of Interferon and Cytokine Research, 27(6), pp. 517-523. doi: 10.1089/jir.2007.0155.

Taylor, M. W. et al. (2004) 'Global Effect of PEG-IFN-α and Ribavirin on Gene Expression in PBMC in Vitro', Journal of Interferon and Cytokine Research, 24(2), pp. 107-118. doi: 10.1089/107999004322813354.

Teijaro, J. R. et al. (2013) 'Persistent LCMV infection is controlled by blockade of type I interferon signaling', Science, 340(6129), pp. 207-211. doi: 10.1126/science.1235214.

Thomas, C. et al. (2011) 'Structural linkage between ligand discrimination and receptor activation by Type i interferons', Cell, 146(4), pp. 621-632. doi: 10.1016/j.cell.2011.06.048.

Trinchieri, G. (2010) 'Type I interferon: Friend or foe?', Journal of Experimental Medicine, 207(10), pp. 2053-2063. doi: 10.1084/jem.20101664.

Uno, K. et al. (1988) 'Effect of recombinant human interferon-αa/d on in vivo murine tumor cell growth', Cancer Research, 48(9), pp. 2366-2371.

van Pesch, V. et al. (2004) 'Characterization of the Murine Alpha Interferon Gene Family', Journal of Virology, 78(15), pp. 8219-8228. doi: 10.1128/jvi.78.15.8219-8228.2004.

Villarreal, D. O. et al. (2017) 'Targeting of CD122 enhances antitumor immunity by altering the tumor immune environment', Oncotarget, 8(65), pp. 109151-109160. doi: 10.18632/oncotarget.22642.

von Wussow, P. et al. (1988) 'Intralesional interferon-alpha therapy in advanced malignant melanoma', Cancer, 61(6), pp. 1071-1074. doi: 10.1002/1097-0142(19880315)61:6<1071::AID-CNCR2820610603>3.0.CO;2-T.

Walter, M. R. et al. (1998) 'Review of recent developments in the molecular characterization of recombinant alfa interferons on the 40th anniversary of the discovery of interferon', Cancer Biotherapy and Radiopharmaceuticals, 13(3), pp. 143-154. doi: 10.1089/cbr.1998.13.143.

Watermann, I. et al. (2007) 'Activation of CD95L fusion protein prodrugs by tumor-associated proteases', Cell Death and Differentiation, 14(4), pp. 765-774. doi: 10.1038/sj.cdd.4402051.

Weber, H. et al. (1987) 'Single amino acid changes that render human IFN-alpha 2 biologically active on mouse cells.', The EMBO journal, 6(3), pp. 591-598. doi: 10.1002/j.1460-2075.1987.tb04795.x.

Weck, P. K. et al. (1981) 'Comparison of the antiviral activities of various cloned human interferon-α subtypes in mammalian cell cultures', Journal of General Virology, 57(1), pp. 233-237. doi: 10.1099/0022-1317-57-1-233.

Weidle, U. H., Tiefenthaler, G. and Georges, G. (2014) 'Proteases as activators for cytotoxic prodrugs in antitumor therapy', Cancer Genomics and Proteomics, 11(2), pp. 67-80.

Wilmes, S. et al. (2020) 'Mechanism of homodimeric cytokine receptor activation and dysregulation by oncogenic mutations', Science, 367(6478), pp. 643-652. doi: 10.1126/science.aaw3242.

Wilson, E. B. et al. (2013) 'Blockade of chronic type I interferon signaling to control persistent LCMV infection', Science, 340(6129), pp. 202-207. doi: 10.1126/science.1235208.

Xuan, C. et al. (2010) 'Targeted delivery of interferon-alpha via fusion to anti-CD20 results in potent antitumor activity against B-cell lymphoma', Blood, 115(14), pp. 2864-2871. doi: 10.1182/blood-2009-10-250555.

Yamaji, K. et al. (2006) 'Interferon-α/β upregulate IL-15 expression in vitro and in vivo: Analysis in human hepatocellular carcinoma cell lines and in chronic hepatitis C patients during interferon-α/β treatment', Cancer Immunology, Immunotherapy, 55(4), pp. 394-403. doi: 10.1007/s00262-005-0005-x.

Yang, X. et al. (2014) 'Targeting the tumor microenvironment with interferon-β bridges innate and adaptive immune responses', Cancer Cell, 25(1), pp. 37-48. doi: 10.1016/j.ccr.2013.12.004.

Youngster, S. et al. (2015) 'Structure, Biology, and Therapeutic Implications of Pegylated Interferon', pp. 2139-2157.

Zhang, K. J. et al. (2017) 'A potent in Vivo antitumor efficacy of novel recombinant type i interferon', Clinical Cancer Research, 23(8), pp. 2038-2049. doi: 10.1158/1078-0432.CCR-16-1386.

Zibelman, M. and Plimack, E. R. (2019) 'Pembrolizumab plus ipilimumab or pegylated interferon alfa-2b for patients with melanoma or renal cell carcinoma: take new drugs but keep the old?', Annals of Translational Medicine, 7(S3), pp. S95-S95. doi: 10.21037/atm.2019.04.57.

Zimmerer, J. M. et al. (2008) 'Gene expression profiling reveals similarities between the in vitro and in vivo responses of immune effector cells to IFN-α', Clinical Cancer Research, 14(18), pp. 5900-5906. doi: 10.1158/1078-0432.CCR-08-0846.

Zitvogel, L. et al. (2015) 'Type I interferons in anticancer immunity', Nature Reviews Immunology, 15(7), pp. 405-414. doi: 10.1038/nri3845.

International Search Report and Written Opinion issued in PCT/US2022/020492, dated Oct. 5, 2022, 17 pages.

Uccellini et al., "ISRE-Reporter Mouse Reveals High Basal and Induced Type I IFN Responses in Inflammatory Monocytes", Cell Rep. (2018); 25(10): 2784-2796.

(56) References Cited

OTHER PUBLICATIONS

Rivero-Juarez et al., "KIR2DS2 as predictor of thrombocytopenia secondary to pegylated interferon-alpha therapy", The Pharmacogenomics Journal (2017) 17, 360-365.
Breznik et al., "Proteases and cytokines as mediators of interactions between cancer and stromal cells in tumours", Biol. Chem. (2017); 398(7): 709-719.
Chen et al., "Type I IFN protects cancer cells from CD8+ T cell-mediated cytotoxicity after radiation, The Journal of Clinical Investigation", vol. 129, No. 10, (2019), 4224-4238.
Chernajovsky et al., Response under 37 C.F.R. §1.111 filed in U.S. Appl. No. 15/322,129, filed Feb. 25, 2019, 27 pages.
Wagner et al., "Evolution of the six horse IGHG genes and corresponding immunoglobulin gamma heavy chains", Immunogenetics (2002) 54: pp. 353-364.
Gull et al., "Development of latent Interferon alpha 2b as a safe therapeutic for treatment of Hepatitis C virus infection", Scientific Reports, (2019) 9:10867, 12 pages.
Wagner B et al: "Horse cytokine/IgG fusion proteins—mammalian expression of biologically active cytokines and a system to verify antibody specificity to equine cytokines", Veterinary Immunology and Immunopathology, Amsterdam, NL, vol. 105, No. 1-2, May 1, 2005 (May 1, 2005), pp. 1-14, XP027671923.
Jazayeri, J A et al: "Fc-based cytokines: Prospects for engineering superior therapeutics", Biodrugs, Adis International LTD, NZ, vol. 22, No. 1, Jan. 1, 2008 (Jan. 1, 2008), pp. 11-26, XP009148905.
Le Scolan, Erwan: "Conditional Cytokine Therapeutics for Tumor-Selective Biological Activity—Preclinical characterization of a dual-masked IFN[alpha]-2b", , Mar. 24, 2021 (Mar. 24, 2021), pp. 1-14, XP055819390.
Written Opinion and International Search Report issued in PCT/US2021/026675 dated Sep. 2, 2021, 26 pages.

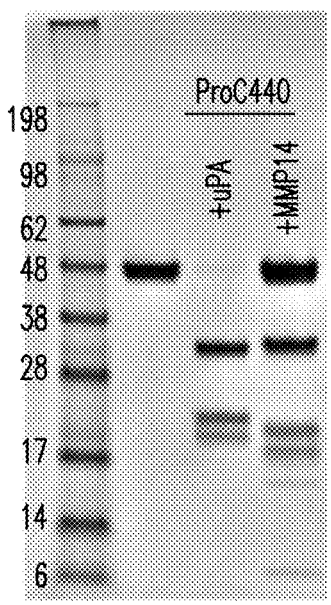

FIG. 6A

ProC440 LC-MS data:

MMP14 cleavage
L161 uPA cleavage: 25145.1 Da
S169

CDLPQTHSLGSRRTLMLLAQMRRISLFSCLKDRHDFGFPQEEFGNQFQKAETIPVLHEMIQQIFNLFSTKDSSA
AWDETLLDKFYTELYQQLNDLEACVIQGVGVTETPLMKEDSILAVRKYFQRITLYLKEKKYSPCAWEVVRAEIM
RSFSLSTNLQESLRSKESGRSDNICPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQPREP
QVYTLPPSQEEMTKNQVSLTCLVKGFYPSDIAVEWESNGQPENNYKTTPVLDSDGSFFLYSRLTVDKSRWQ
QGNVFSCSVMHEALHNHYTQKSLSLS

FIG. 6B

*METDTLLLWVLLLWVPGSTG*

QSGQTDVDYYREWSWTQVSGSSGGSLSGRSDNIGSGGSCDLPQTHSLG
SRRTLMLLAQMRRISLFSCLKDRHDFGFPQEEFGNQFQKAETIPVLHE
MIQQIFNLFSTKDSSAAWDETLLDKFYTELYQQLNDLEACVIQGVGVT
ETPLMKEDSILAVRKYFQRITLYLKEKKYSPCAWEVVRAEIMRSFSLS
TNLQESLRSKELSGRSDNICPPCPAPEFLGGPSVFLFPPKPKDTLMIS
RTPEVTCVVVDVSQEDPEVQFNWYVDGVEVHNAKTKPREEQFNSTYRV
VSVLTVLHQDWLNGKEYKCKVSNKGLPSSIEKTISKAKGQPREPQVYT
LPPSQEEMTKNQVSLTCLVKGFYPSDIAVEWESNGQPENNYKTTPPVL
DSDGSFFLYSRLTVDKSRWQQGNVFSCSVMHEALHNHYTQKSLSLS (ProC732)

FIG. 8

*METDTLLLWVLLLWVPGSTG*

QSGQTDVDYYREWSWTQVSGSSGGSLSGRSDNIGSGGSCDLPQTHSLG
SRRTLMLLAQMRRISLFSCLKDRHDFGFPQEEFGNQFQKAETIPVLHE
MIQQIFNLFSTKDSSAAWDETLLDKFYTELYQQLNDLEACVIQGVGVT
ETPLMKEDSILAVRKYFQRITLYLKEKKYSPCAWEVVRAEIMRSFSLS
TNLQESLRSKEESKYGPPCPPCPAPEFLGGPSVFLFPPKPKDTLMISR
TPEVTCVVVDVSQEDPEVQFNWYVDGVEVHNAKTKPREEQFNSTYRVV
SVLTVLHQDWLNGKEYKCKVSNKGLPSSIEKTISKAKGQPREPQVYTL
PPSQEEMTKNQVSLTCLVKGFYPSDIAVEWESNGQPENNYKTTPPVLD
SDGSFFLYSRLTVDKSRWQQGNVFSCSVMHEALHNHYTQKSLSLS (ProC733)

FIG. 9

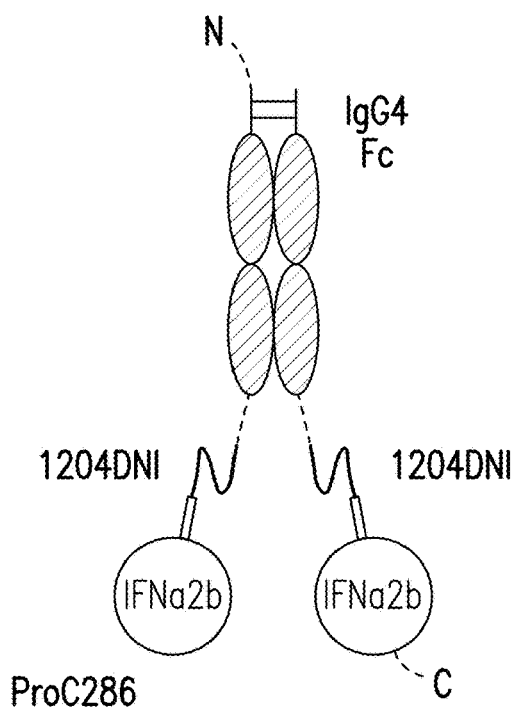
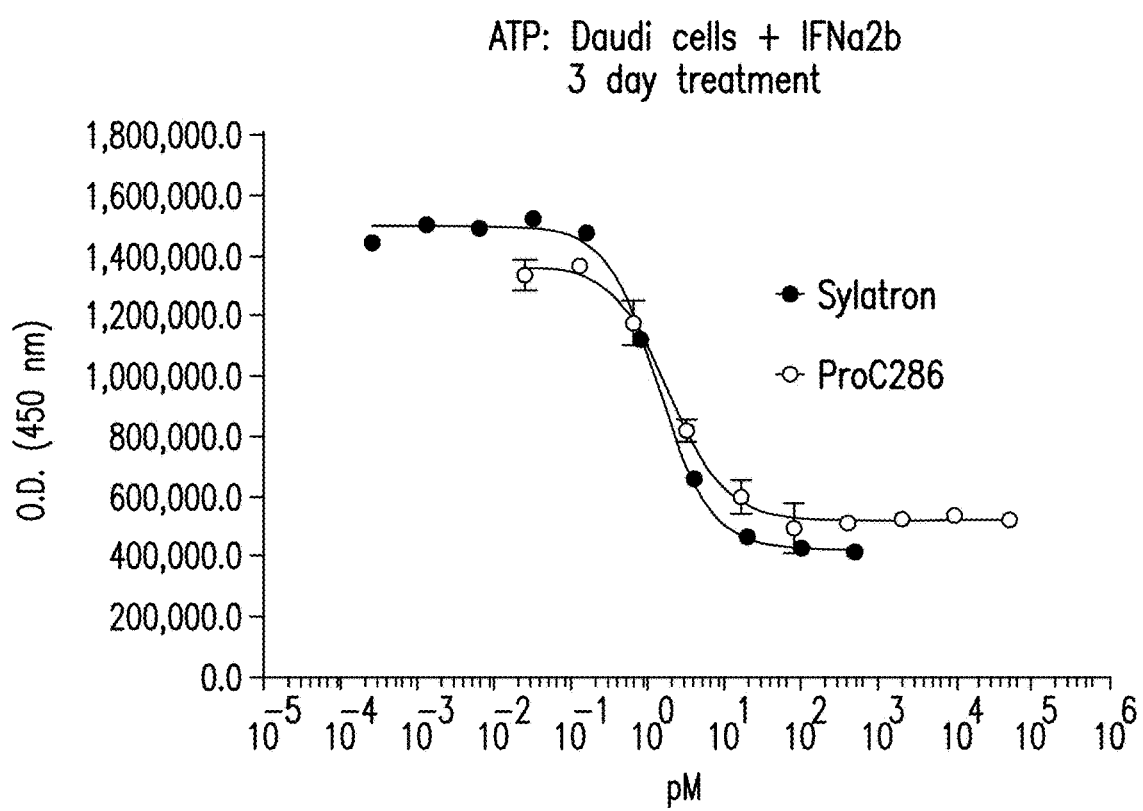
FIG. 11A

Daudi proliferation assay
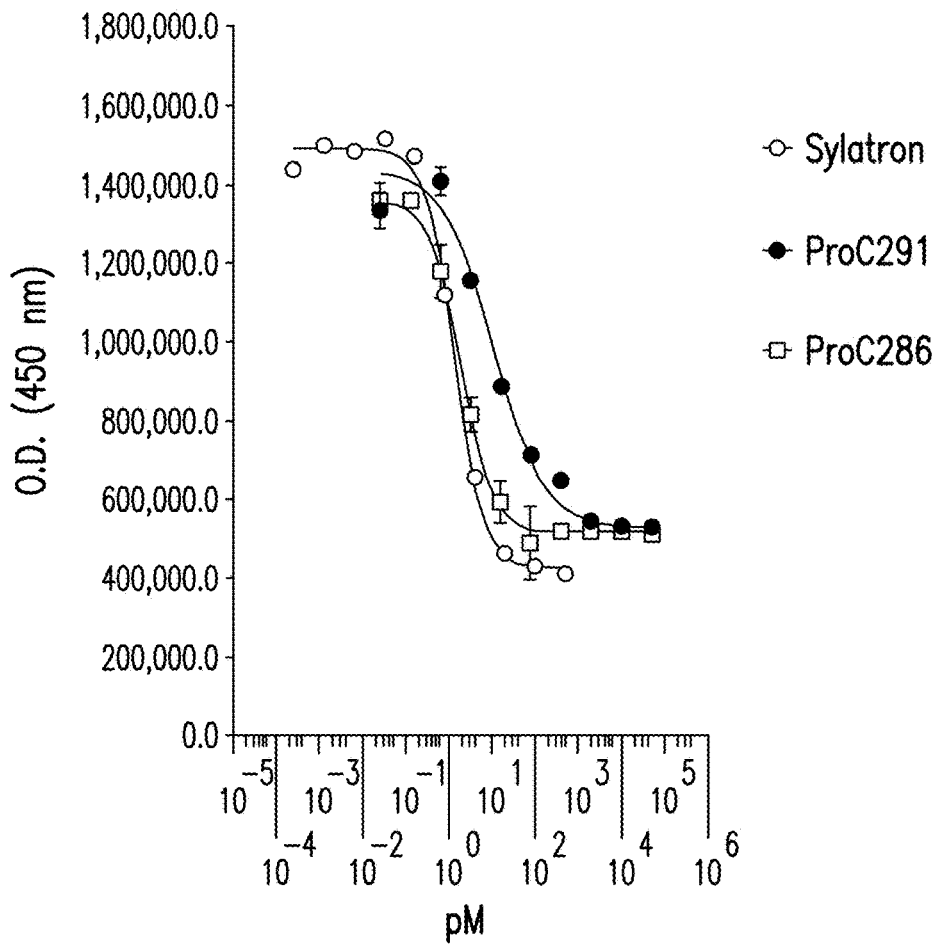
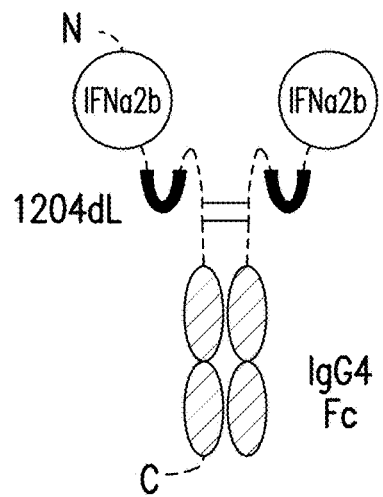
FIG. 11B

| | IFNa-con | ProC440+uPA | PEG-IFNa2b (Sylatron) | ProC440 |
|---|---|---|---|---|
| Specific activity | $1-2 \times 10^9$ U/mg | $3.5 \times 10^8$ U/mg | $0.7 \times 10^8$ U/mg | $1.3 \times 10^7$ U/mg |
| Anticipated toxic dose | 0.1 mpk * | 0.288 mpk | 1.43 mpk | 7.68 mpk |

FIG. 12

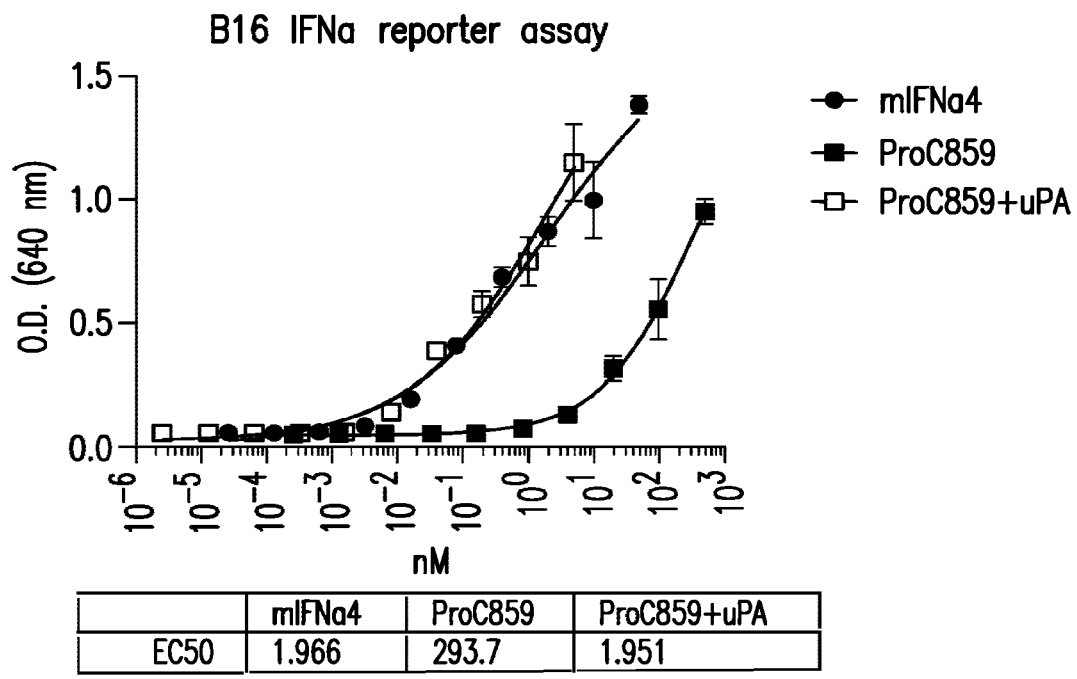
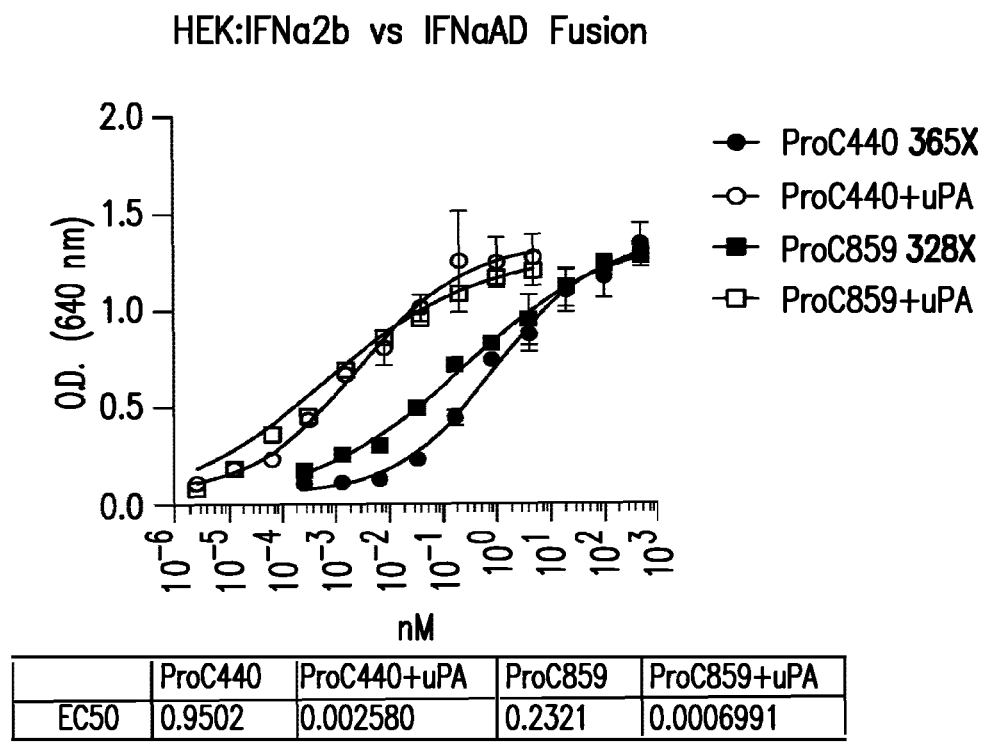
FIG. 17 (cont'd)

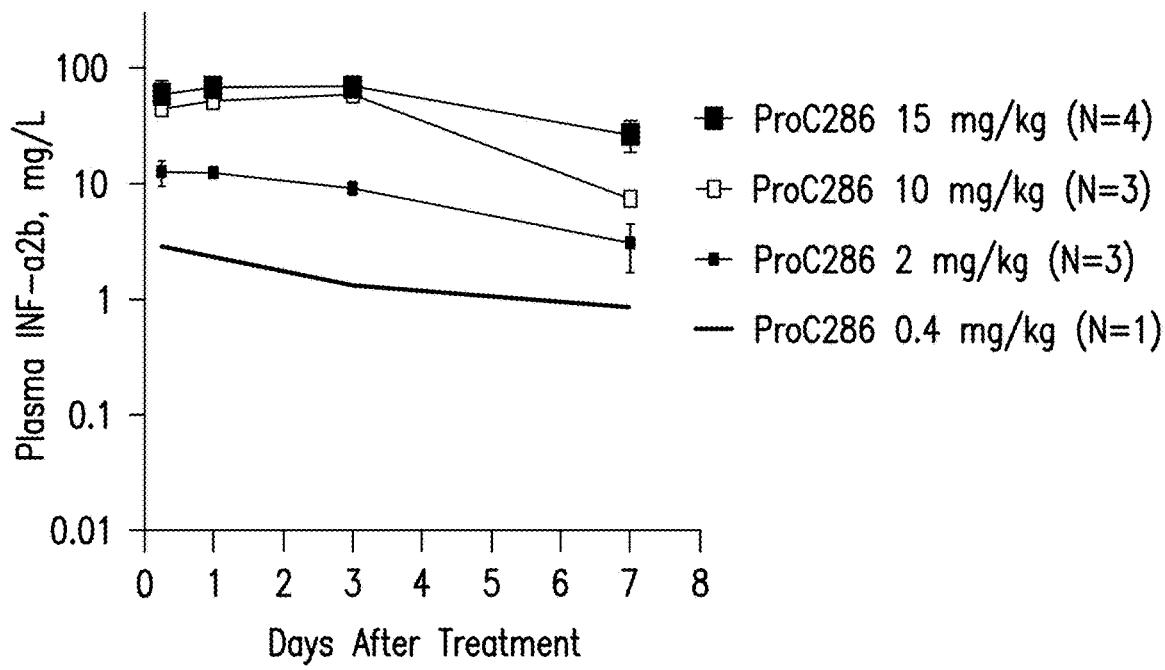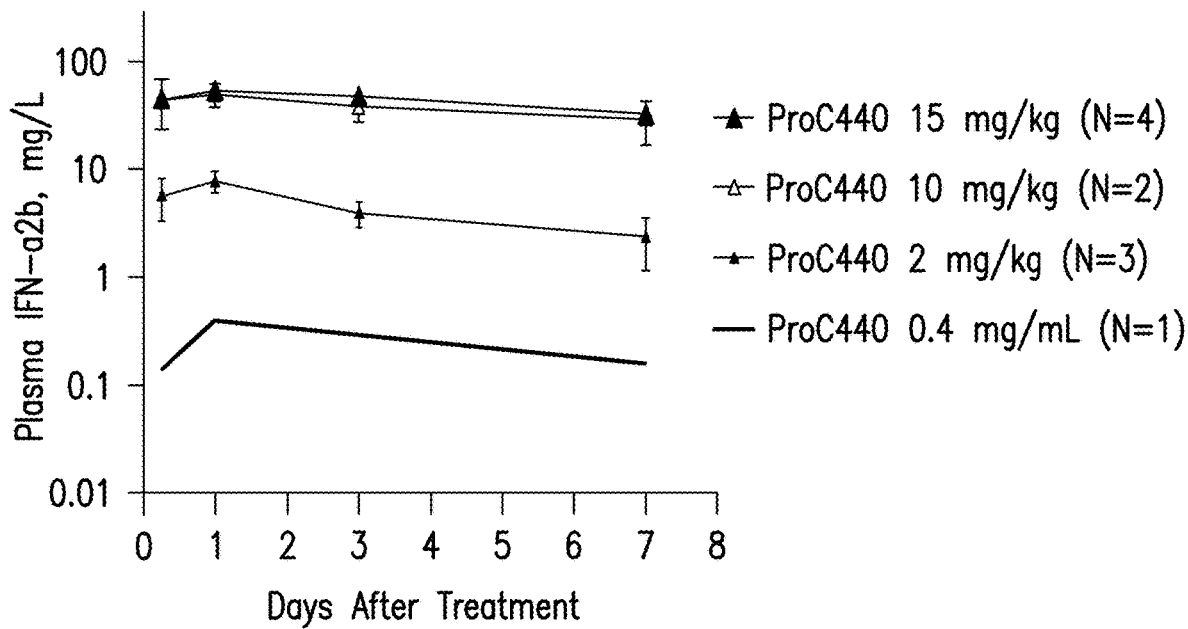
FIG. 26

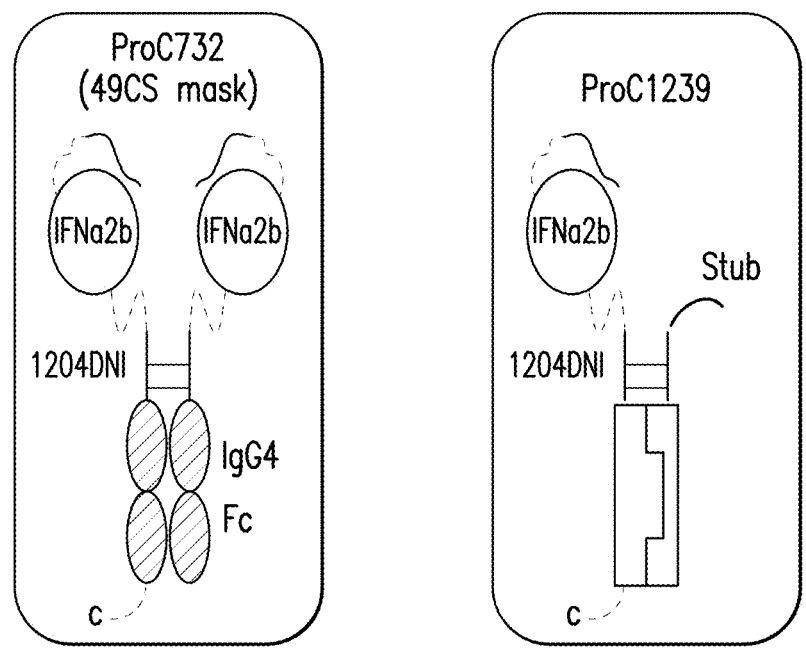
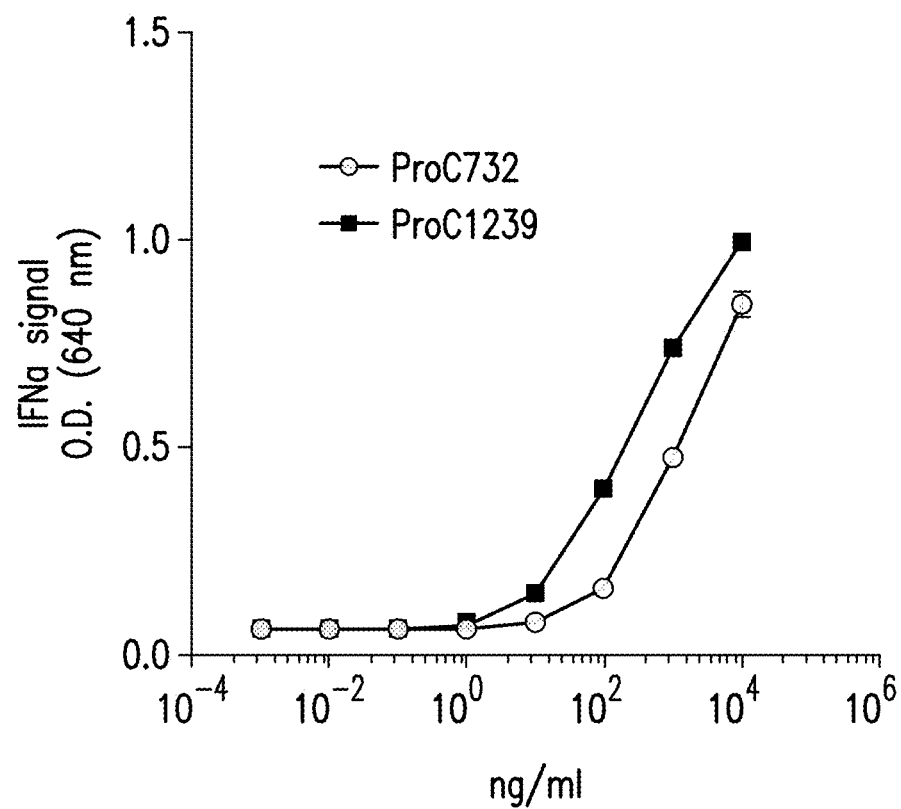
FIG. 29

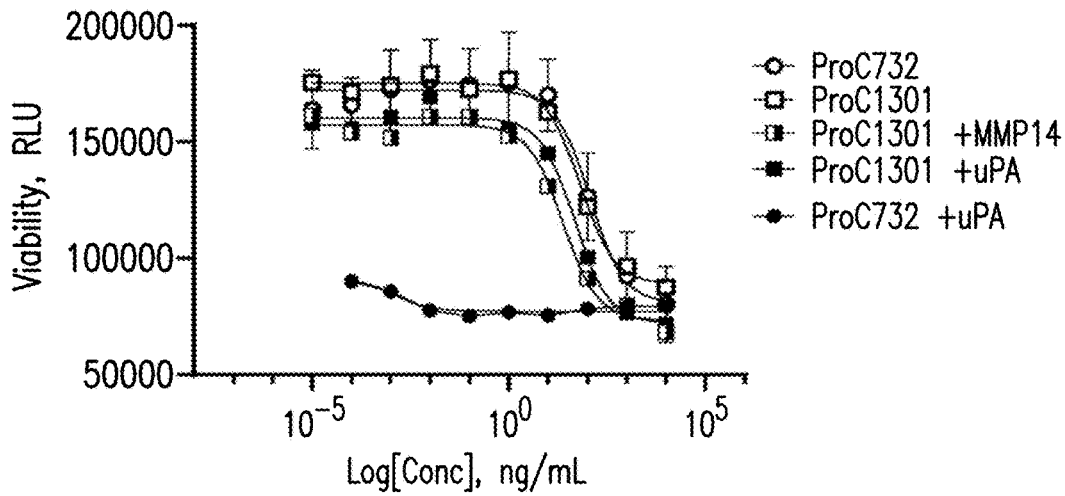

```
IFNa2b  1    CDLPQTHSLGSRRTLMLLAQMRKISLFSCLKDRHDFGFPQEEFGNQFQKAETIPVLHEMI  60
             CDLPQTHSLGSRRTLMLLAQMRKISLFSCLKDRHDFGFPQEEFGNQFQKAETIPVLHEMI
IFNaAD  1    CDLPQTHSLGSRRTLMLLAQMRKISLFSCLKDRHDFGFPQEEFGNQFQKAETIPVLHEMI  60

IFNa2b  61   QQIFNLFSTKDSSAAWDETLLDKFYTELYQQLNDLEACVIQGVGVTETPLMKEDSILAVR  120
             QQIFNLF+TKDSSAAWDE LLDKF TELYQQLNDLEACV+Q   V ETPLM  DSILAV+
IFNaAD  61   QQIFNLFTTKDSSAAWDEDLLDKFCTELYQQLNDLEACVMQEERVGETPLMNVDSILAVK  120
                                                            L161 (MMP14 cleavage)
IFNa2b  121  KYFQRITLYLKEKKYSPCAWEVVRAEIMRSFSLSTNLQESLRSKE   165
             KYF+RITLYL EKKYSPCAWEVVRAEIMRS SLSTNLQE LR KE
IFNaAD  121  KYFRRITLYLTEKKYSPCAWEVVRAEIMRSLSLSTNLQERLRRKE   165

L157 & 161 (predicted MMP12 cleavage)
```

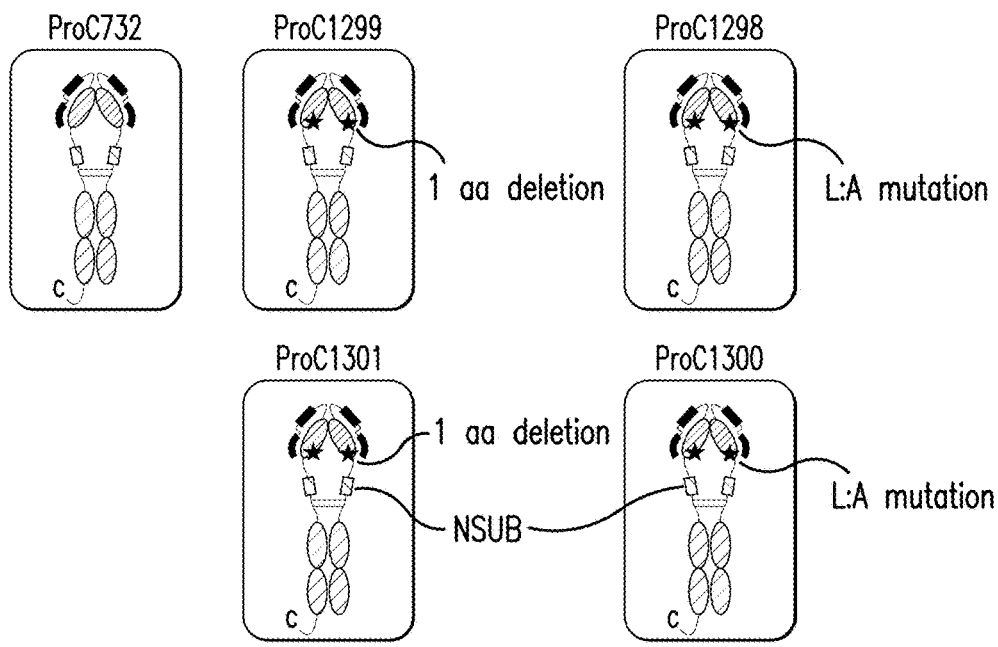

FIG. 35C

MASKED ACTIVATABLE INTERFERON CONSTRUCTS

CROSS-REFERENCE TO RELATED APPLICATIONS

The present application claims priority benefit of U.S. provisional application Nos. 63/161,913, filed Mar. 16, 2021; 63/164,827, filed Mar. 23, 2021; 63/254,748, filed Oct. 12, 2021; and 63/276,893, filed Nov. 8, 2021, the disclosures of which are incorporated herein by reference in their entireties.

REFERENCE TO SEQUENCE LISTING

The present application includes a Sequence Listing filed in electronic format. The "Sequence Listing" submitted electronically concurrently herewith pursuant 37 C.F.R. § 1.821 in computer readable form (CRF) via EFS-Web is entitled "CYTX-079_ST25.txt," was created on Mar. 16, 2022, and is 644,254 bytes in size. The information in the electronic format of the Sequence Listing is part of the present application and is incorporated herein by reference in its entirety.

TECHNICAL FIELD

The present disclosure relates to the field of biotechnology, and more specifically, to activatable cytokine constructs.

BACKGROUND

Cytokines are a family of naturally-occurring small proteins and glycoproteins produced and secreted by most nucleated cells in response to viral infection and/or other antigenic stimuli. Interferons are a subclass of cytokines. Interferons are presently grouped into three major classes: interferon type I, interferon type II, and interferon type III. Interferons exert their cellular activities by binding to specific membrane receptors on a cell surface.

Interferon therapy has many clinical benefits. For example, interferons are known to up-regulate the immune system and also to have antiviral and anti-proliferative properties. These biological properties have led to the clinical use of interferons as therapeutic agents for the treatment of viral infections and malignancies. Further, interferons are useful for recruiting a patient's innate immune system to identify and attack cancer cells. Accordingly, interferon therapy has been extensively used in cancer and antiviral therapy, including for the treatment of hepatitis, Kaposi sarcoma, hairy cell leukemia, chronic myeloid leukemia (CML), follicular lymphoma, renal cell cancer (RCC), melanoma, and other disease states. However, systemic administration of interferons is accompanied by dose-dependent toxicities, including strong flu-like symptoms, neurological symptoms, hepatotoxicity, bone marrow suppression, and arrythmia, among others. In a melanoma patient study, the combination of Pembrolizumab and Pegylated IFNa led to an investigator-assessed objective response rate ("ORR") of 60.5%. The combination treatment was also associated with 49% of G3/G4 adverse events which required dose reduction of Pegylated IFNa (Davar et al., J. Clin. Oncol., 2018). These undesired side-effects have limited the dosage of interferon therapies and sometimes leads to discontinuation or delay of interferon treatment.

Interleukins are another subclass of cytokines. Interleukins regulate cell growth, differentiation, and motility. They are particularly important in stimulating immune responses, such as inflammation. Interleukins have been used for treatment of cancer, autoimmune disorders, and other disorders. For example, interleukin-2 (IL2) is indicated for treatment of melamona, graft-versus-host disease (GVHD), neuroblastoma, renal cell cancer (RCC), and is also considered useful for conditions including acute coronary syndrome, acute myeloid syndrome, atopic dermatitis, autoimmune liver diseases, basal cell carcinoma, bladder cancer, breast cancer, candidiasis, colorectal cancer, cutaneous T-cell lymphoma, endometriomas, HIV invention, ischemic heart disease, rheumatoid arthritis, nasopharyngeal adenocarcimoa, non-small cell lung cancer (NSCLC), ovarian cancer, pancreatic cancer, systemic lupus erythematosus, tuberculosis, and other disorders. Other interleukins, such as IL-6, IL-7, IL-12, and IL-21, among others, are potential treatments for cancers and other disorders. Interleukin therapy is often accompanied by undesired side effects, including flu-like symptoms, nausea, vomiting, diarrhea, low blood pressure, and arrhythmia, among others.

Thus, the need and desire for improved specificity and selectivity of cytokine therapy to the desired target is of great interest. Increased targeting of cytokine therapeutics to the disease site could reduce systemic mechanism-based toxicities and lead to broader therapeutic utility.

SUMMARY

The present disclosure provides activatable cytokine constructs (ACCs) that include: (a) a first monomer comprising a first peptide mask (PM1), a first mature cytokine protein (CP1), a first and a third cleavable moieties (CM1 and CM3), and a first dimerization domain (DD1), wherein the CM1 is positioned between the CP1 and the DD1, and the CM3 is positioned between the PM1 and the CP1; and (b) a second monomer comprising a second mature cytokine protein (CP2), a second cleavable moiety (CM2), and a second dimerization domain (DD2), wherein the CM2 is positioned between the CP2 and the DD2, where: the CM1, the CM2, and the CM3 function as a substrate for a protease; the DD1 and the DD2 bind to each other; and where the ACC is characterized by a reduction in at least one activity of the CP1 and/or CP2 as compared to a control level of the at least one activity of the CP1 and/or CP2. The protease(s) that cleave the CM1, CM2, and CM3 may be over-expressed in diseased tissue (e.g., tumor tissue) relative to healthy tissue. The ACC may be activated upon cleavage of the CM1, CM2, and/or CM3 so that the cytokine may exert its activity in the diseased tissue (e.g., in a tumor microenvironment) while the cytokine activity is attenuated in the context of healthy tissue. Thus, the ACCs provided herein may provide reduced toxicity relative to traditional cytokine therapeutics, enable higher effective dosages of cytokine, and/or increase the therapeutic window for the cytokine.

Provided herein are activatable cytokine constructs (ACC) that include a first monomer construct and a second monomer construct, wherein: (a) the first monomer construct comprises a first peptide mask (PM1), a first mature cytokine protein (CP1), a first and a third cleavable moieties (CM1 and CM3), and a first dimerization domain (DD1), wherein the CM1 is positioned between the CP1 and the DD1, and the CM3 is positioned between the PM1 and the CP1; and (b) the second monomer construct comprises a second mature cytokine protein (CP2), a second cleavable moiety (CM2), and a second dimerization domain (DD2), wherein the CM2 is positioned between the CP2 and the DD2; wherein the DD1 and the DD2 bind each other thereby forming a dimer of the first monomer construct and the second monomer construct; and wherein the ACC is characterized by having a reduced level of at least one CP1 and/or CP2 activity as compared to a control level of the at least one CP1 and/or CP2 activity.

In some embodiments, the second monomer construct further comprises a second peptide mask (PM2) and a fourth cleavable moiety (CM4), wherein the CM4 is positioned between the PM2 and the CP2. In some embodiments, the first monomer construct comprises a first polypeptide that comprises the PM1, the CM3, the CP1, the CM1, and the DD1. In some embodiments, the second monomer construct comprises a second polypeptide that comprises the CP2, the CM2, and the DD2. In some embodiments, the second monomer construct comprises a second polypeptide that comprises the PM2, the CM4, the CP2, the CM2, and the DD2.

In some embodiments, the PM1 comprises a sequence selected from the group consisting of SEQ ID NOs: 328, 329, 323, and 331-369, and the CP1 is an interferon; the PM1 comprises a sequence selected from the group consisting of SEQ ID NOs: 328, 329, 323, and 331-364, and the CP1 is an interferon α; the PM1 comprises a sequence selected from the group consisting of SEQ ID NOs: 331-360, 362-364, and the CP1 is an interferon β; the PM1 comprises a sequence selected from the group consisting of SEQ ID NOs: 331-360, 366-369, and the CP1 is an interferon γ; the PM1 comprises a sequence selected from the group consisting of SEQ ID NOs: 370-374, and the CP1 is an IL-12; the PM1 comprises a sequence selected from the group consisting of SEQ ID NOs: 375-382, 469-477, 478, and the CP1 is an IL-15; the PM1 comprises a sequence selected from the group consisting of SEQ ID NOs: 383-468, 469-478, and the CP1 is an IL-2; or the PM1 comprises a sequence selected from the group consisting of SEQ ID NOs: 478 and 479, and the CP1 is an IL-21. In some embodiments, the PM2 comprises a sequence selected from the group consisting of SEQ ID NOs: 328, 329, 323, and 331-369, and the CP2 is an interferon; the PM2 comprises a sequence selected from the group consisting of SEQ ID NOs: 328, 329, 323, and 331-364, and the CP2 is an interferon α; the PM2 comprises a sequence selected from the group consisting of SEQ ID NOs: 331-360, 362-364, and the CP2 is an interferon β; the PM2 comprises a sequence selected from the group consisting of SEQ ID NOs: 331-360, 366-369, and the CP2 is an interferon γ; the PM2 comprises a sequence selected from the group consisting of SEQ ID NOs: 370-374, and the CP2 is an IL-12; the PM2 comprises a sequence selected from the group consisting of SEQ ID NOs: 375-382, 469-477, 478, and the CP2 is an IL-15; the PM2 comprises a sequence selected from the group consisting of the group consisting of SEQ ID NOs: 383-468, 469-478, and the CP2 is an IL-2; or the PM2 comprises a sequence selected from the group consisting of SEQ ID NOs: 478 and 479, and the CP2 is an IL-21. In some embodiments, the PM1 comprises an amino acid sequence selected from the group consisting of SEQ ID NOs: 328-329, 323, and 331-479. In some embodiments, the PM2 comprises an amino acid sequence selected from the group consisting of SEQ ID NOs: 328-329, 323, and 331-479.

In some embodiments, the DD1 and the DD2 are a pair selected from the group consisting of: a pair of Fc domains, a sushi domain from an alpha chain of human IL-15 receptor (IL15Ra) and a soluble IL-15; barnase and barnstar; a protein kinase A (PKA) and an A-kinase anchoring protein (AKAP); adapter/docking tag modules based on mutated RNase I fragments; an epitope and single domain antibody (sdAb); an epitope and single chain variable fragment (scFv); and soluble N-ethyl-maleimide sensitive factor attachment protein receptors (SNARE) modules based on interactions of the proteins syntaxin, synaptotagmin, synaptobrevin, and SNAP25, an antigen-binding domain and an epitope.

In some embodiments, the DD1 and the DD2 are a pair of Fc domains. In some embodiments, the pair of Fc domains is a pair of human Fc domains. In some embodiments, the human Fc domains are human IgG1 Fc domains, human IgG2 Fc domains, human IgG3 Fc domains, or human IgG4 Fc domains. In some embodiments, the human Fc domains are human IgG4 Fc domains. In some embodiments, the human Fc domains each comprise a sequence that is at least 80% identical to SEQ ID NO: 3. In some embodiments, the human Fc domains each comprise a sequence that is at least 90%, 95%, 96%, 97%, 98%, or 99% identical to SEQ ID NO: 3. In some embodiments, the human Fc domains comprise SEQ ID NO: 3. In some embodiments, the DD1 and the DD2 comprise SEQ ID NOs: 318 and 319, respectively. In some embodiments, the DD1 and the DD2 are the same. In some embodiments, the human Fc domains include mutations to eliminate glycosylation and/or to reduce Fc-gamma receptor binding. In some embodiments, the human Fc domains comprise the mutation N297Q, N297A, or N297G; in some embodiments the human Fc domains comprise a mutation at position 234 and/or 235, for example L235E, or L234A and L235A (in IgG1), or F234A and L235A (in IgG4); in some embodiments the human Fc domains are IgG2 Fc domains that comprise the mutations V234A, G237A, P238S, H268Q/A, V309L, A330S, or P331S, or a combination thereof (all according to EU numbering).

Additional examples of engineered human Fc domains are known to those skilled in the art. Examples of Ig heavy chain constant region amino acids in which mutations in at least one amino acid leads to reduced Fc function include, but are not limited to, mutations in amino acid 228, 233, 234, 235, 236, 237, 239, 252, 254, 256, 265, 270, 297, 318, 320, 322, 327, 329, 330, and 331 of the heavy constant region (according to EU numbering). Examples of combinations of mutated amino acids are also known in the art, such as, but not limited to a combination of mutations in amino acids 234, 235, and 331, such as L234F, L235E, and P331S or a combination of amino acids 318, 320, and 322, such as E318A, K320A, and K322A.

Further examples of engineered Fc domains include F243L/R292P/Y300L/V305I/P396 IgG1; S239D/I332E IgG1; S239D/I332E/A330L IgG1; S298A/E333A/K334A; in one heavy chain, L234Y/L235Q/G236W/S239M/H268D/D270E/S298A IgG1, and in the opposing heavy chain, D270E/K326D, A330M/K334E IgG; G236A/S239D/I332E IgG1; K326W/E333S IgG1; S267E/H268F/S324T IgG1; E345R/E430G/S440Y IgG1; N297A or N297Q or N297G IgG1; L235E IgG1; L234A/L235A IgG1; F234A/L235A IgG4; H268Q/V309L/A330S/P331S IgG2; V234A/G237A/P238S/H268A/V309L/A330S/P331S IgG2; M252Y/S254T/T256E IgG1; M428L/N434S IgG1; S267E/L328F IgG1; N325S/L328F IgG1, and the like. In some embodiments, the engineered Fc domain comprises one or more substitutions selected from the group consisting of N297A IgG1, N297Q IgG1, and S228P IgG4.

In some embodiments, the DD1 comprises an antigen-binding domain and the DD2 comprises a corresponding epitope. In some embodiments, the antigen-binding domain is an anti-His tag antigen-binding domain and wherein the DD2 comprises a His tag. In some embodiments, the antigen-binding domain is a single chain variable fragment (scFv). In some embodiments, the antigen-binding domain is a single domain antibody (sdAb). In some embodiments, at least one of the DD1 and the DD2 comprises a dimerization domain substituent selected from the group consisting of a non-polypeptide polymer and a small molecule. In some embodiments, the DD1 and the DD2 comprise non-polypeptide polymers covalently bound to each other. In some embodiments, the non-polypeptide polymer is a sulfur-containing polyethylene glycol, and wherein the DD1 and the DD2 are covalently bound to each other via one or more disulfide bonds. In some embodiments, at least one of the DD1 and the DD2 comprises a small molecule. In some embodiments, the small molecule is biotin. In some embodiments, the DD1 comprises biotin and the DD2 comprises an avidin.

In some embodiments, the CP1 and the CP2 are mature cytokines. In some embodiments, each of the CP1 and the CP2 comprise a mature cytokine sequence and further comprise a signal peptide. A signal peptide is also referred to herein as a "signal sequence." In some embodiments, the CP1 and/or the CP2 is/are each individually selected from the group consisting of: an interferon, an interleukin, GM-CSF, G-CSF, LIF, OSM, CD154, LT-β, TNF-α, TNF-β, 4-1BBL, APRIL, CD70, CD153, CD178, GITRL, LIGHT, OX40L, TALL-1, TRAIL, TWEAK, TRANCE, TGF-β1, TGF-β1, TGF-β3, Epo, Tpo, Flt-3L, SCF, M-CSF, and MSP, optionally wherein the CP1 and/or the CP2 is independently selected from IL-2, IL-7, IL-8, IL-10, IL-12, IL-15, IL-21, an IFN-alpha, an IFN beta, an IFN gamma, GM-CSF, TGF-beta, LIGHT, GITR-L, CD40L, CD27L, 4-1BB-L, OX40, and OX40L. In some embodiments, the CP1 and the CP2 are the same. In some embodiments, the CP1 and the CP2 are different. In some embodiments, the CP1 and/or the CP2 is/are an interferon. In some embodiments, the CP1 and the CP2 both are an interferon. In some embodiments, the CP1 and the CP2 are different interferons. In some embodiments, the CP1 and the CP2 are the same interferon. In some embodiments, one of the CP1 or the CP2 is an interferon, and the other of CP1 or CP2 is a cytokine other than an interferon. In some aspects, one or both cytokines are monomeric cytokines. In some aspects, one or both interferons are monomeric interferons. In some aspects, either CP1 or CP2 is a monomeric interferon and the other CP1 or CP2 is a different cytokine. In some aspects, the CP1 and/or the CP2 include a mutant cytokine sequence. In some aspects, the CP1 and/or the CP2 include a universal cytokine sequence. In some aspects, the CP1 and/or the CP2 include a truncated sequence that retains cytokine activity.

In some embodiments, the interferon(s) is/are a human wildtype mature interferon. In some embodiments, the interferon(s) may be type I and type II interferons, for example including, but not limited to interferon-alpha, interferon-beta, interferon-gamma, interferon-omega, and interferon-tau. In some embodiments, the interferons is/are an interferon-alpha. In some embodiments, the interferon(s) is/are selected from the group consisting of: interferon alpha-2a, interferon alpha-2b, and interferon alpha-n3. In some embodiments, the interferon(s) is/are interferon alpha-2b. In some embodiments, the interferon(s) is/are a mutant interferon. In some embodiments, the interferon(s) is/are a mutant interferon wherein an endogenous protease cleavage site has been rendered disfunctional by substitution, deletion, or insertion of one or more amino acids. In some embodiments, the interferon(s) is/are a universal cytokine molecule, e.g., having a hybrid sequence of different cytokine subtypes or a chimeric cytokine sequence or a humanized cytokine sequence. In some embodiments, the interferon(s) is/are a universal interferon molecule. In some embodiments, the interferon(s) is/are a universal interferon alpha, e.g., a hybrid of interferon alpha 1 and interferon alpha 2a. In some embodiments, the CP1 and/or the CP2 comprises a sequence that is at least 80% identical to SEQ ID NO: 1. In some embodiments, the CP1 and/or the CP2 comprises a sequence that is at least 90%, 95%, 96%, 97%, 98%, or 99% identical to SEQ ID NO: 1. In some embodiments, the CP1 and/or the CP2 comprises a sequence of SEQ ID NO: 1. In some embodiments, the interferon is an interferon beta. In some embodiments, the interferon beta is selected from the group consisting of interferon beta-1a, and interferon beta-1b. In some embodiments, the CP1 and/or the CP2 comprises an IFab domain. In some embodiments, the CP1 and/or the CP2 comprises an interleukin. In some embodiments, the interleukin is selected from the group consisting of IL-1α, IL-1β, IL-1RA, IL-18, IL-2, IL-4, IL-7, IL-9, IL-13, IL-15, IL-3, IL-5, IL-6, IL-11, IL-12, IL-10, IL-20, IL-14, IL-16, and IL-17.

In some embodiments, the CM1 and/or the CM2 comprise a total of about 3 amino acids to about 15 amino acids. In some embodiments, the CM1 and the CM2 comprise substrates for different proteases. In some embodiments, wherein the CM1 and the CM2 comprise substrates for the same protease. In some embodiments, the protease(s) is/are selected from the group consisting of: ADAM8, ADAM9, ADAM10, ADAM12, ADAM15, ADAM17/TACE, ADAM-DEC1, ADAMTS1, ADAMTS4, ADAMTS5, BACE, Renin, Cathepsin D, Cathepsin E, Caspase 1, Caspase 2, Caspase 3, Caspase 4, Caspase 5, Caspase 6, Caspase 7, Caspase 8, Caspase 9, Caspase 10, Caspase 14, Cathepsin B, Cathepsin C, Cathepsin K, Cathepsin L, Cathepsin S, Cathepsin V/L2, Cathepsin X/Z/P, Cruzipain, Legumain, Otubain-2, KLK4, KLK5, KLK6, KLK7, KLK8, KLK10, KLK11, KLK13, KLK14, Meprin, Neprilysin, PSMA, BMP-1, matrix metalloproteinases (e.g., MMP-1, MMP-2, MMP-3, MMP-7, MMP-9, MMP-10, MMP-11, MMP-12, MMP-13, MMP-14, MMP-15, MMP-16, MMP-17, MMP-19, MMP-20, MMP-23, MMP-24, MMP-26, MMP-27), activated protein C, cathepsin A, cathepsin G, Chymase, FVIIa, FIXa, FXa, FXIa, FXIIa, Elastase, Granzyme B, Guanidinobenzoatase, HtrA1, human neutrophil lyase, lactoferrin, marapsin, NS3/4A, PACE4, Plasmin, PSA, tPA, thrombin, tryptase, uPA, DESC1, DPP-4, FAP, Hepsin, Matriptase-2, MT-SP1/Matriptase, TMPRSS2, TMPRSS3, and TMPRSS4. In some embodiments, the protease(s) is/are selected from the group consisting of: uPA, legumain, MT-SP1, ADAM17, BMP-1, TMPRSS3, TMPRSS4, MMP-2, MMP-9, MMP-12, MMP-13, and MMP-14.

Suitable cleavable moieties have been disclosed in WO 2010/081173, WO 2015/048329, WO 2015/116933, WO 2016/118629, and WO 2020/118109, the disclosures of which are incorporated herein by reference in their entireties.

In some embodiments, the CM1 and/or the CM2 comprise a sequence selected from the group consisting of: LSGRSDNH (SEQ ID NO: 5), TGRGPSWV (SEQ ID NO: 6), PLTGRSGG (SEQ ID NO: 7), TARGPSFK (SEQ ID NO: 8), NTLSGRSENHSG (SEQ ID NO: 9), NTLSGRSGNHGS (SEQ ID NO: 10), TSTSGRSANPRG (SEQ ID NO: 11), TSGRSANP (SEQ ID NO: 12), VHMPLGFLGP (SEQ ID NO: 13), AVGLLAPP (SEQ ID NO: 14), AQNLLGMV (SEQ ID NO: 15), QNQALRMA (SEQ ID NO: 16), LAAPLGLL (SEQ ID NO: 17), STFPFGMF (SEQ ID NO: 18), ISSGLLSS (SEQ ID NO: 19), PAGLWLDP (SEQ ID NO: 20), VAGRSMRP (SEQ ID NO: 21), VVPEGRRS (SEQ ID NO: 22), ILPRSPAF (SEQ ID NO: 23), MVLGRSLL (SEQ ID NO: 24), QGRAITFI (SEQ ID NO: 25), SPRSIMLA (SEQ ID NO: 26), SMLRSMPL (SEQ ID NO: 27), ISSGLLSGRSDNH (SEQ ID NO: 28), AVGLLAPPGGLSGRSDNH (SEQ ID NO: 29), ISSGLLSSGGSGGSLSGRSDNH (SEQ ID NO: 30), LSGRSGNH (SEQ ID NO: 31), SGRSANPRG (SEQ ID NO: 32), LSGRSDDH (SEQ ID NO: 33), LSGRSDIH (SEQ ID NO: 34), LSGRSDQH (SEQ ID NO: 35), LSGRSDTH (SEQ ID NO: 36), LSGRSDYH (SEQ ID NO: 37), LSGRSDNP (SEQ ID NO: 38), LSGRSANP (SEQ ID NO: 39), LSGRSANI (SEQ ID NO: 40), LSGRSDNI (SEQ ID NO: 41), MIAPVAYR (SEQ ID NO: 42), RPSPMWAY (SEQ ID NO: 43), WATPRPMR (SEQ ID NO: 44), FRLLDWQW (SEQ ID NO: 45), ISSGL (SEQ ID NO: 46), ISSGLLS (SEQ ID NO: 47), ISSGLL (SEQ ID NO: 48), ISSGLLSGRSANPRG (SEQ ID NO: 49), AVGLLAPPTSGRSANPRG (SEQ ID NO: 50), AVGLLAPPSGRSANPRG (SEQ ID NO: 51), ISSGLLSGRSDDH (SEQ ID NO: 52), ISSGLLSGRSDIH (SEQ ID NO: 53), ISSGLLSGRSDQH (SEQ ID NO: 54), ISSGLLSGRSDTH (SEQ ID NO: 55), ISSGLLSGRSDYH (SEQ ID NO: 56), ISSGLLSGRSDNP (SEQ ID NO: 57), ISSGLLSGRSANP (SEQ ID NO: 58), ISSGLLSGRSANI (SEQ ID NO: 59), AVGLLAPPGGLSGRSDDH (SEQ ID NO: 60), AVGLLAPPGGLSGRSDIH (SEQ ID NO: 61), AVGLLAPPGGLSGRSDQH (SEQ ID NO: 62), AVGLLAPPGGLSGRSDTH (SEQ ID NO: 63), AVGLLAPPGGLSGRSDYH (SEQ ID NO: 64), AVGLLAPPGGLSGRSDNP (SEQ ID NO: 65), AVGLLAPPGGLSGRSANP (SEQ ID NO: 66), AVGLLAPPGGLSGRSANI (SEQ ID NO: 67), ISSGLLSGRSDNI (SEQ ID NO: 68), AVGLLAPPGGLSGRSDNI (SEQ ID NO: 69), GLSGRSDNHGGAVGLLAPP (SEQ ID NO: 70), GLSGRSDNHGGVHMPLGFLGP (SEQ ID NO: 71), LSGRSDNHGGVHMPLGFLGP (SEQ ID NO: 72), ISSGLSS (SEQ ID NO: 73), PVGYTSSL (SEQ ID NO: 74), DWLYWPGI (SEQ ID NO: 75), LKAAPRWA (SEQ ID NO: 76), GPSHLVLT (SEQ ID NO: 77), LPGGLSPW (SEQ ID NO: 78), MGLFSEAG (SEQ ID NO: 79), SPLPLRVP (SEQ ID NO: 80), RMHLRSLG (SEQ ID NO: 81), LLAPSHRA (SEQ ID NO: 82), GPRSFGL (SEQ ID NO: 83), GPRSFG (SEQ ID NO: 84), SARGPSRW (SEQ ID NO: 85), GGWHTGRN (SEQ ID NO: 86), HTGRSGAL (SEQ ID NO: 87), AARGPAIH (SEQ ID NO: 88), RGPAFNPM (SEQ ID NO: 89), SSRGPAYL (SEQ ID NO: 90), RGPATPIM (SEQ ID NO: 91), RGPA (SEQ ID NO: 92), GGQPSGMWGW (SEQ ID NO: 93), FPRPLGITGL (SEQ ID NO: 94), SPLTGRSG (SEQ ID NO: 95), SAGFSLPA (SEQ ID NO: 96), LAPLGLQRR (SEQ ID NO: 97), SGGPLGVR (SEQ ID NO: 98), PLGL (SEQ ID NO: 99), and SGRSDNI (SEQ ID NO: 100). In some embodiments, the CM comprises a sequence selected from the group consisting of: ISSGLLSGRSDNH (SEQ ID NO: 28), LSGRSDDH (SEQ ID NO: 33), ISSGLLSGRSDQH (SEQ ID NO: 54), SGRSDNI (SEQ ID NO: 100), and ISSGLLSGRSDNI (SEQ ID NO: 68). In some embodiments, the protease(s) is/are produced by a tumor in the subject, e.g., the protease(s) are produced in greater amounts in the tumor than in healthy tissues of the subject. In some embodiments, the subject has been diagnosed or identified as having a cancer.

In some embodiments, the CP1 and the CM1 directly abut each other in the first monomer construct. In some embodiments, the CM1 and the DD1 directly abut each other in the first monomer construct. In some embodiments, the CP2 and the CM2 directly abut each other in the second monomer construct. In some embodiments, the CM2 and the DD2 directly abut each other in the second monomer construct. In some embodiments, the first monomer construct comprises the CP1 directly abutting the CM1, and the CM1 directly abutting the DD1, wherein the CM1 comprises a sequence that is selected from the group consisting of SEQ ID Nos 5-100. In some embodiments, the second monomer construct comprises the CP2 directly abutting the CM2, and the CM2 directly abutting the DD2, wherein the CM2 comprises a sequence that is selected from the group consisting of SEQ ID Nos 5-100. In some embodiments, the first monomer construct comprises the CP1 directly abutting the CM1, and the CM1 directly abutting the DD1, wherein the CM1 comprises a sequence that is no more than 13, 12, 11, 10, 9, 8, 7, 6, 5 or 4 amino acids in length. In some embodiments, the second monomer construct comprises the CP2 directly abutting the CM2, and the CM2 directly abutting the DD2, wherein the CM2 comprises a sequence that is no more than 13, 12, 11, 10, 9, 8, 7, 6, 5 or 4 amino acids in length. In some embodiments, the first and second monomer construct each are configured such that the cytokine (CM1 and CM2, respectively) directly abuts a cleavable moiety (CM1 and CM2, respectively) that is no more than 10, 9, 8, 7, 6, 5, or 4 amino acids in length, and the cleavable moiety directly abuts a dimerization domain (DD1 and DD2, respectively) that is the Fc region of a human IgG, wherein the N-terminus of the Fc region is the first cysteine residue (reading in the N- to C-direction) in the hinge region that participates in a disulfide linkage with a second Fc domain (e.g., Cysteine 226 of human IgG1, using EU numbering). In some aspects, the dimerization domain is an IgG Fc region wherein the upper hinge residues have been deleted. For example, the Fc is a variant wherein N-terminal sequences EPKSCDKTHT (SEQ ID NO: 330), ERK, ELKTPLGDTTHT (SEQ ID NO: 365), or ESKYGPP (SEQ ID NO: 317) have been deleted.

In some embodiments, the first monomer construct comprises at least one linker. In some embodiments, the at least one linker is a linker L1 disposed between the PM1 and the CM3 and/or a linker L2 disposed between the CM3 and the CP1. In some embodiments, the second monomer construct comprises at least one linker. In some embodiments, the at least one linker is a linker L3 disposed between the PM2 and the CM4 and/or a linker L4 disposed between the CM4 and the CP2. In some embodiments, the first monomer construct comprises a linker L1 and the second monomer construct comprises a linker L3. In some embodiments, L1 and L3 are the same. In some embodiments, the first monomer construct comprises a linker L2 and the second monomer construct comprises a linker L4. In some embodiments, L2 and L4 are the same. In some embodiments, the first monomer construct comprises a linker between the CP1 and CM1 and/or a linker between the CM1 and the DD1. In some embodiments, the second monomer construct comprises a linker between the CP2 and the CM2 and/or a linker between the CM2 and the DD2. In some embodiments, each linker has a total length of 1 amino acid to about 15 amino acids. In some embodiments, each linker has a total length of at least 5 amino acids.

In some embodiments, the first monomer construct comprises at least one linker, wherein each linker is independently selected from the group consisting of GSSGGSGGSGG (SEQ ID NO: 210); GGGS (SEQ ID NO: 2); GGGSGGGS (SEQ ID NO: 211); GGGSGGGSGGGS (SEQ ID NO: 212); GGGGSGGGGSGGGGS (SEQ ID NO: 213); GGGGSGGGGSGGGGSGGGGSGGGGS (SEQ ID NO: 214); GGGGSGGGGS (SEQ ID NO: 215); GGGGS (SEQ ID NO: 216); GS; GGGGSGS (SEQ ID NO: 217); GGGGSGGGGSGGGGSGS (SEQ ID NO: 218);

GGSLDPKGGGGS (SEQ ID NO: 219); PKSCDKTH-
TCPPCPAPELLG (SEQ ID NO: 220); SKYGPPCPPCPA-
PEFLG (SEQ ID NO: 221); GKSSGSGSESKS (SEQ ID
NO: 222); GSTSGSGKSSEGKG (SEQ ID NO: 223); GST-
SGSGKSSEGSGSTKG (SEQ ID NO: 224); GST-
SGSGKPGSGEGSTKG (SEQ ID NO: 225); GST-
SGSGKPGSSEGST (SEQ ID NO: 226); (GS)n, (GGS)n,
(GSGGS)n (SEQ ID NO: 227), (GGGS)n (SEQ ID NO:
228), (GGGGS)n (SEQ ID NO: 216), wherein each n is an
integer of at least one; GGSG (SEQ ID NO: 229); GGSGG
(SEQ ID NO: 230); GSGSG (SEQ ID NO: 231; GSGGG
(SEQ ID NO: 232); GGGSG (SEQ ID NO: 233); GSSSG
(SEQ ID NO: 234); GGGGSGGGGSGGGGS (SEQ ID NO:
213); GGGGSGGGGSGGGGSGGGGS (SEQ ID NO: 214);
and GSTSGSGKPGSSEGST (SEQ ID NO: 226). In some
embodiments, the linker comprises a sequence of GGGS
(SEQ ID NO: 2).

In some embodiments, the first monomer construct, comprises in an N- to C-terminal direction, the PM1, the CM3, the CP1, the CM1, and, linked directly or indirectly to the C-terminus of the CM1, the DD1. In some embodiments, the first polypeptide comprises in a C- to N-terminal direction, the PM1, the CM3, the CP1, the CM1, and, linked directly or indirectly to the N-terminus of the CM1, the DD1. In some embodiments, the second polypeptide comprises in a N- to C-terminal direction, the PM2, the CM4, the CP2, the CM2, and, linked directly or indirectly to the C-terminus of the CM2, the DD2. In some embodiments, the second polypeptide comprises in a C- to N-terminal direction, the PM2, the CM4, the CP2, the CM2, and, linked directly or indirectly to the CM2, the DD2.

In some embodiments, the first monomer construct comprises in an N- to C-terminal direction, the CP1, an optional linker, the CM1, an optional linker, and the DD1, wherein DD1 is an Fc region of an IgG, wherein the N-terminus of the Fc region is the first cysteine residue (reading in the N- to C-direction) in the hinge region that participates in a disulfide linkage with a second Fc domain (e.g., Cysteine 226 of human IgG1 or IgG4, using EU numbering), and wherein the CM1 and any linker(s) interposed between the CP1 and the N-terminal cysteine of DD1 (the "linking region") have a combined total length of no more than 18, 17, 16, 15, 14, 13, 12, 11, 10, 9, 8, 7, 6, 5, or 4 amino acids, preferably no more than 10 amino acids, especially preferably no more than 7 amino acids. In some such embodiments, the first monomer construct further comprises, in an N- to C-terminal direction, the PM1, an optional linker, the CM3, and an optional linker attached to the N-terminus of the CP1. In some embodiments, the second monomer construct comprises in an N- to C-terminal direction, the CP2, an optional linker, the CM2, an optional linker, and the DD2, wherein DD2 is an Fc region of an IgG, wherein the N-terminus of the Fc region is the first cysteine residue (reading in the N- to C-direction) in the hinge region that participates in a disulfide linkage with a second Fc domain (e.g., Cysteine 226 of human IgG1 or IgG4, using EU numbering), and wherein the CM2 and any linker(s) interposed between the CP2 and the N-terminal cysteine of the DD2 (the "linking region") have a combined total length of no more than 18, 17, 16, 15, 14, 13, 12, 11, 10, 9, 8, 7, 6, 5, or 4 amino acids, preferably no more than 10 amino acids, especially preferably no more than 7 amino acids. In some such embodiments, the second monomer construct further comprises, in an N- to C-terminal direction, the PM2, an optional linker, the CM4, and an optional linker attached to the N-terminus of the CP2. In some aspects, there is no linker or spacer between a peptide mask and a cleavable moiety. In some aspects, there is no linker or spacer between a cytokine protein and a cleavable moiety. In some aspects, there is no linker or spacer between a cleavable moiety and a dimerization domain.

In some embodiments, the ACC is a homodimer in which the first monomer construct and the second monomer construct are identical and comprise the amino acid sequence of SEQ ID NO: 321. In some embodiments, the first monomer construct and the second monomer construct each comprise an amino acid sequence that is at least 90%, 95%, 96%, 97%, 98%, or 99% identical to SEQ ID NO: 321. In some embodiments, the first monomer construct and the second monomer construct each comprise, in an N- to C-terminal direction, SEQ ID NO: 323; an optional flexible linker of zero to 10 amino acids; a CM comprising an amino acid sequence selected from the group consisting of SEQ ID NO: 41, SEQ ID NO: 68, and SEQ ID NO: 100; an optional flexible linker of zero to 10 amino acids; SEQ ID NO:1; a second CM comprising an amino acid sequence selected from the group consisting of SEQ ID NO: 41, SEQ ID NO: 68, and SEQ ID NO: 100; and a dimerization domain.

In some embodiments, the at least one CP1 and/or CP2 activity is a binding affinity of the CP1 and/or the CP2 for its cognate receptor as determined using surface plasmon resonance. For example, where the CP1 or CP2 is an interferon, the cognate receptor may be the interferon-alpha/beta receptor (IFNAR). In some embodiments, the at least one CP1 and/or CP2 activity is a level of proliferation of lymphoma cells. In some embodiments, the at least one CP1 and/or CP2 activity is the level of JAK/STAT/ISGF3 pathway activation in a lymphoma cell. In some embodiments, the at least one activity is a level of secreted alkaline phosphatase (SEAP) production in a lymphoma cell. In some embodiments, the ACC is characterized by at least a 2-fold reduction in at least one of the CP1 and the CP2 activity as compared to the control level. In some embodiments, the ACC is characterized by at least a 5-fold, 10-fold, 20-fold, 50-fold, 100-fold, 200-fold, 300-fold, 400-fold, 500-fold, 600-fold, 700-fold, 800-fold, 900-fold, 1000-fold, 1100-fold, 1200-fold, 1300-fold, 1400-fold, 1500-fold, 1600-fold, 1700-fold, 1800-fold, 1900-fold, 2000-fold, 3000-fold, or 4000-fold reduction in at least one CP1 and/or the CP2 activity as compared to the control level. In some embodiments, the ACC is characterized by at least a 5000-fold reduction in at least one activity of the CP1 and/or the CP2 as compared to the control level. In some embodiments, the control level of the at least one activity of the CP1 and/or CP2, is the activity of the CP1 and/or the CP2 in the ACC following exposure of the ACC to the protease(s). In some embodiments, the control level of the at least one CP1 and/or the CP2, is the corresponding the CP1 and/or the CP2 activity of a corresponding wildtype mature cytokine.

In some embodiments, the ACC is characterized by generating a cleavage product following exposure to the protease(s), wherein the cleavage product comprises the at least one activity of the CP1 and/or the CP2. In some embodiments, the at least one activity of the CP1 and/or the CP2 is anti-proliferation activity. In some embodiments, the control level is an EC50 value of the wildtype mature cytokine, and wherein ratio of EC50 (cleavage product) to EC50 (wildtype control level) is less than about 10, or less than about 9, or less than about 8, or less than about 7, or less than about 6, or less than about 5, or less than about 4, or less than about 3, or less than about 2, or less than about 1.5, or equal to about 1. In some embodiments, the EC50 of the cleavage product is approximately the same as the EC50 of the wildtype mature cytokine, demonstrating that the following cleavage, the activity of the CP1 and/or CP2 is fully recovered, or nearly fully recovered.

Provided herein are compositions comprising any one of the ACCs described herein. In some embodiments, the composition is a pharmaceutical composition. Also provided herein are kits comprising at least one dose of any one of the compositions described herein.

Provided herein are methods of treating a subject in need thereof comprising administering to the subject a therapeutically effective amount of any one of the ACCs described herein or any one of the compositions described herein. In some embodiments, the subject has been identified or diagnosed as having a cancer. In some non-limiting embodiments, the cancer is Kaposi sarcoma, hairy cell leukemia, chronic myeloid leukemia (CML), follicular lymphoma, renal cell cancer (RCC), melanoma, neuroblastoma, basal cell carcinoma, bladder cancer, breast cancer, colorectal cancer, cutaneous T-cell lymphoma, nasopharyngeal adenocarcimoa, non-small cell lung cancer (NSCLC), ovarian cancer, pancreatic cancer. In some non-limiting embodiments, the cancer is a lymphoma. In some non-limiting embodiments, the lymphoma is Burkitt's lymphoma.

Provided herein are nucleic acids encoding a polypeptide that comprises the CP1 and the CM1 of any one of the ACCs described herein. In some embodiments, the polypeptide further comprises any one of the DD1 described herein. In some embodiments, the polypeptide further comprises any one of the PM1 and the CM3 described herein. Also provided herein are nucleic acids encoding a polypeptide that comprises the CP2 and the CM2 of any one of the ACCs described herein. When the monomers are identical, then the present disclosure provides a single nucleic acid encoding the monomer that dimerizes to form ACC. In some embodiments, the polypeptide further comprises any one of the DD2 described herein. In some embodiments, the polypeptide further comprises any one of the PM2 and the CM4 described herein. In certain embodiments, the first monomer construct and the second monomer construct comprise identical CP, CM, and DD components. In some of these embodiments, the first and second monomer constructs are encoded by the same polypeptide (i.e., the same amino acid sequence). Often, when the first and second monomer constructs comprise the same amino acid sequence, they are encoded by the same nucleic acid (i.e., the same nucleic acid sequence). In some of these embodiments, the first and second monomer constructs are encoded by the same nucleic acid. Also provided herein are vectors comprising any one of the nucleic acids described herein. In some embodiments, the vector is an expression vector. Also provided herein are cells comprising any one of the nucleic acids described herein or any one of the vectors described herein.

Provided herein are pairs of nucleic acids that together encode a polypeptide that comprises the CP1 and the CM1 of the first monomer construct and a polypeptide that comprises the CP2 and the CM2 of the second monomer construct of any one of the ACCs described herein. Also provided herein are pairs of nucleic acids that together encode a polypeptide that comprises the PM1, the CM3, CP1 and the CM1 of the first monomer construct and a polypeptide that comprises the PM2, the CM4, the CP2 and the CM2 of the second monomer construct of any one of the ACCs described herein. Also provided herein are pairs of vectors that together comprise any of one of the pair of nucleic acids described herein. In some embodiments, the pair of vectors is a pair of expression vectors. Also provided herein are cells comprising any one of the pairs of nucleic acids described herein or any one of the pairs of vectors described herein. In other embodiments, the present invention provides a vector comprising the pair of vectors.

Provided herein are methods of producing an ACC comprising: culturing any one of the cells described herein in a liquid culture medium under conditions sufficient to produce the ACC; and recovering the ACC from the cell or the liquid culture medium. In some embodiments, the method further comprises: isolating the ACC recovered from the cell or the liquid culture medium. In some embodiments, the method further comprises: formulating isolated ACC into a pharmaceutical composition.

Provided herein are ACCs produced by any one of the methods described herein. Also provided herein are compositions comprising any one the ACCs described herein. Also provided herein are compositions of any one of the compositions described herein, wherein the composition is a pharmaceutical composition. Also provided herein are kits comprising at least one dose of any one of the compositions described herein.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

The term "a" and "an" refers to one or more (i.e., at least one) of the grammatical object of the article. By way of example, "a cell" encompasses one or more cells.

As used herein, the terms "about" and "approximately," when used to modify an amount specified in a numeric value or range, indicate that the numeric value as well as reasonable deviations from the value known to the skilled person in the art. For example, ±20%, ±10%, or ±5%, are within the intended meaning of the recited value where appropriate.

Concentrations, amounts, and other numerical data may be expressed or presented herein in a range format. It is to be understood that such a range format is used merely for convenience and brevity and thus should be interpreted flexibly to include not only the numerical values explicitly recited as the limits of the range, but also to include all the individual numerical values or sub-ranges encompassed within that range as if each numerical value and sub-range is explicitly recited. As an illustration, a numerical range of "about 0.01 to 2.0" should be interpreted to include not only the explicitly recited values of about 0.01 to about 2.0, but also include individual values and sub-ranges within the indicated range. Thus, included in this numerical range are individual values such as 0.5, 0.7, and 1.5, and sub-ranges such as from 0.5 to 1.7, 0.7 to 1.5, and from 1.0 to 1.5, etc. Furthermore, such an interpretation should apply regardless of the breadth of the range or the characteristics being described. Additionally, it is noted that all percentages are in weight, unless specified otherwise.

In understanding the scope of the present disclosure, the terms "including" or "comprising" and their derivatives, as used herein, are intended to be open ended terms that specify the presence of the stated features, elements, components, groups, integers, and/or steps, but do not exclude the presence of other unstated features, elements, components, groups, integers and/or steps. The foregoing also applies to words having similar meanings such as the terms "including", "having" and their derivatives. The term "consisting" and its derivatives, as used herein, are intended to be closed terms that specify the presence of the stated features, elements, components, groups, integers, and/or steps, but exclude the presence of other unstated features, elements, components, groups, integers and/or steps. The term "consisting essentially of," as used herein, is intended to specify the presence of the stated features, elements, components, groups, integers, and/or steps as well as those that do not materially affect the basic and novel characteristic(s) of features, elements, components, groups, integers, and/or steps. It is understood that reference to any one of these transition terms (i.e. "comprising," "consisting," or "consisting essentially") provides direct support for replacement to any of the other transition term not specifically used. For example, amending a term from "comprising" to "consisting essentially of" or "consisting of" would find direct support due to this definition for any elements disclosed throughout this disclosure. Based on this definition, any element disclosed herein or incorporated by reference may be included in or excluded from the claimed invention.

As used herein, a plurality of compounds, elements, or steps may be presented in a common list for convenience. However, these lists should be construed as though each member of the list is individually identified as a separate and unique member. Thus, no individual member of such list should be construed as a de facto equivalent of any other member of the same list solely based on their presentation in a common group without indications to the contrary.

Furthermore, certain molecules, constructs, compositions, elements, moieties, excipients, disorders, conditions, properties, steps, or the like may be discussed in the context of one specific embodiment or aspect or in a separate paragraph or section of this disclosure. It is understood that this is merely for convenience and brevity, and any such disclosure is equally applicable to and intended to be combined with any other embodiments or aspects found anywhere in the present disclosure and claims, which all form the application and claimed invention at the filing date. For example, a list of constructs, molecules, method steps, kits, or compositions described with respect to a construct, composition, or method is intended to and does find direct support for embodiments related to constructs, compositions, formulations, and methods described in any other part of this disclosure, even if those method steps, active agents, kits, or compositions are not re-listed in the context or section of that embodiment or aspect.

Unless otherwise specified, a "nucleic acid sequence encoding a protein" includes all nucleotide sequences that are degenerate versions of each other and thus encode the same amino acid sequence.

The term "N-terminally positioned" when referring to a position of a first domain or sequence relative to a second domain or sequence in a polypeptide primary amino acid sequence means that the first domain or sequence is located closer to the N-terminus of the polypeptide primary amino acid sequence than the second domain or sequence. In some embodiments, there may be additional sequences and/or domains between the first domain or sequence and the second domain or sequence.

The term "C-terminally positioned" when referring to a position of a first domain or sequence relative to a second domain or sequence in a polypeptide primary amino acid sequence means that the first domain or sequence is located closer to the C-terminus of the polypeptide primary amino acid sequence than the second domain or sequence. In some embodiments, there may be additional sequences and/or domains between the first domain or sequence and the second domain or sequence.

The term "exogenous" refers to any material introduced from or originating from outside a cell, a tissue, or an organism that is not produced by or does not originate from the same cell, tissue, or organism in which it is being introduced.

The term "transduced," "transfected," or "transformed" refers to a process by which an exogenous nucleic acid is introduced or transferred into a cell. A "transduced," "transfected," or "transformed" cell (e.g., mammalian cell) is one that has been transduced, transfected, or transformed with exogenous nucleic acid (e.g., a vector) that includes an exogenous nucleic acid encoding any of the activatable cytokine constructs described herein.

The term "nucleic acid" refers to a deoxyribonucleic acid (DNA) or ribonucleic acid (RNA), or a combination thereof, in either a single- or double-stranded form. Unless specifically limited, the term encompasses nucleic acids containing known analogues of natural nucleotides that have similar binding properties as the reference nucleotides. Unless otherwise indicated, a particular nucleic acid sequence also implicitly encompasses complementary sequences as well as the sequence explicitly indicated. In some embodiments of any of the nucleic acids described herein, the nucleic acid is DNA. In some embodiments of any of the nucleic acids described herein, the nucleic acid is RNA.

Modifications can be introduced into a nucleotide sequence by standard techniques known in the art, such as site-directed mutagenesis and polymerase chain reaction (PCR)-mediated mutagenesis. Conservative amino acid substitutions are ones in which the amino acid residue is replaced with an amino acid residue having a similar side chain. Families of amino acid residues having similar side chains have been defined in the art. These families include: amino acids with acidic side chains (e.g., aspartate and glutamate), amino acids with basic side chains (e.g., lysine, arginine, and histidine), non-polar amino acids (e.g., alanine, valine, leucine, isoleucine, proline, phenylalanine, methionine, and tryptophan), uncharged polar amino acids (e.g., glycine, asparagine, glutamine, cysteine, serine, threonine and tyrosine), hydrophilic amino acids (e.g., arginine, asparagine, aspartate, glutamine, glutamate, histidine, lysine, serine, and threonine), hydrophobic amino acids (e.g., alanine, cysteine, isoleucine, leucine, methionine, phenylalanine, proline, tryptophan, tyrosine, and valine). Other families of amino acids include: aliphatic-hydroxy amino acids (e.g., serine and threonine), amide family (e.g., asparagine and glutamine), aliphatic family (e.g., alanine, valine, leucine and isoleucine), and aromatic family (e.g., phenylalanine, tryptophan, and tyrosine).

As used herein the phrase "specifically binds," or "immunoreacts with" means that the activatable antigen-binding protein complex reacts with one or more antigenic determinants of the desired target antigen and does not react with other polypeptides, or binds at much lower affinity, e.g., about or greater than $10^{-6}$ M.

The term "treatment" refers to ameliorating at least one symptom of a disorder. In some embodiments, the disorder being treated is a cancer and to ameliorate at least one symptom of a cancer.

BRIEF DESCRIPTION OF DRAWINGS

FIGS. 6A-6C show activation of a cytokine construct (ProC440) by proteases uPa and MMP14. FIG. 6B depicts the ProC440 sequence (SEQ ID NO: 316) with MMP14 and uPA cleavable sites.

FIG. 8 shows the sequence of a masked cytokine construct, ProC732 (SEQ ID NO: 321), with an optional signal sequence in italics (SEQ ID NO: 244), the masking peptide sequence in double-underline, the sequences of cleavable moieties in bold, and the sequence of the mature IFNalpha-2b underlined.

FIG. 9 shows shows the sequence of a masked cytokine construct with no cleavable moiety sequence between the cytokine and the dimerization domain, ProC733 (SEQ ID NO: 322), with an optional signal sequence in italics (SEQ ID NO: 244), the masking peptide sequence in double-underline, the cleavable moiety sequence in bold, and the sequence of the mature IFNalpha-2b underlined.

FIG. 11A shows a schematic of the structure of cytokine construct ProC286, and the activity of ProC286 compared to the activity of Sylatron® (PEGylated interferon alpha-2b) in the Daudi apoptosis assay. ProC286 and Sylatron® showed similar levels of activity, indicating that ProC286 could be used as surrogate Sylatron® control to evaluate the tolerability of IFNalpha-2b in the hamster study. FIG. 11B depicts a schematic of the structure of cytokine construct ProC291 and the activity of ProC291 compared to the activity of Sylatron® in the Daudi apotosis assay. ProC291 showed significantly reduced activity compared to Sylatron® and ProC286.

FIG. 12 shows the specific activity of IFNa-con (recombinant interferon alpha, a non-naturally occurring type-I interferon); the active cytokine cleavage product of ProC440 (ProC440+uPA); Sylatron® ("PEG-IFNa2b"); and ProC440, and anticipated toxic dosages in a dose-escalation study in vivo, e.g., at escalating doses of 0.08, 0.4, 2, 10, and 15 mg/kg ("mpk").

FIG. 13A shows data for 2 mg/kg ("2 mpk") dosages; FIG. 13B shows data for 10 mg/kg ("10 mpk") dosages; and FIG. 13C shows data for 15 mg/kg ("15 mpk") dosages of each construct tested.

FIG. 29 shows the activity of monomeric dual masked ProC1239 and dimeric dual masked ProC732 tested in vitro using IFN-responsive HEK293 cells.

FIG. 35C shows IFNa2b (SEQ ID NO: 1) compared to IFNaAD (SEQ ID NO: 481) and that ProC1301 is resistant to activation compared to ProC732.

FIG. 39 shows results where plasma samples were collected at indicated time points and analyzed for total ProC732 concentration. FIG. 40A shows concentrations of IP-10 in serum were measured by MSD V-plex assay. FIG. 40B shows concentrations of circulating Pb-IFN-a2b and IP-10 plotted against each other at day 1 and day 7 after administration.

DETAILED DESCRIPTION

Figure 1:
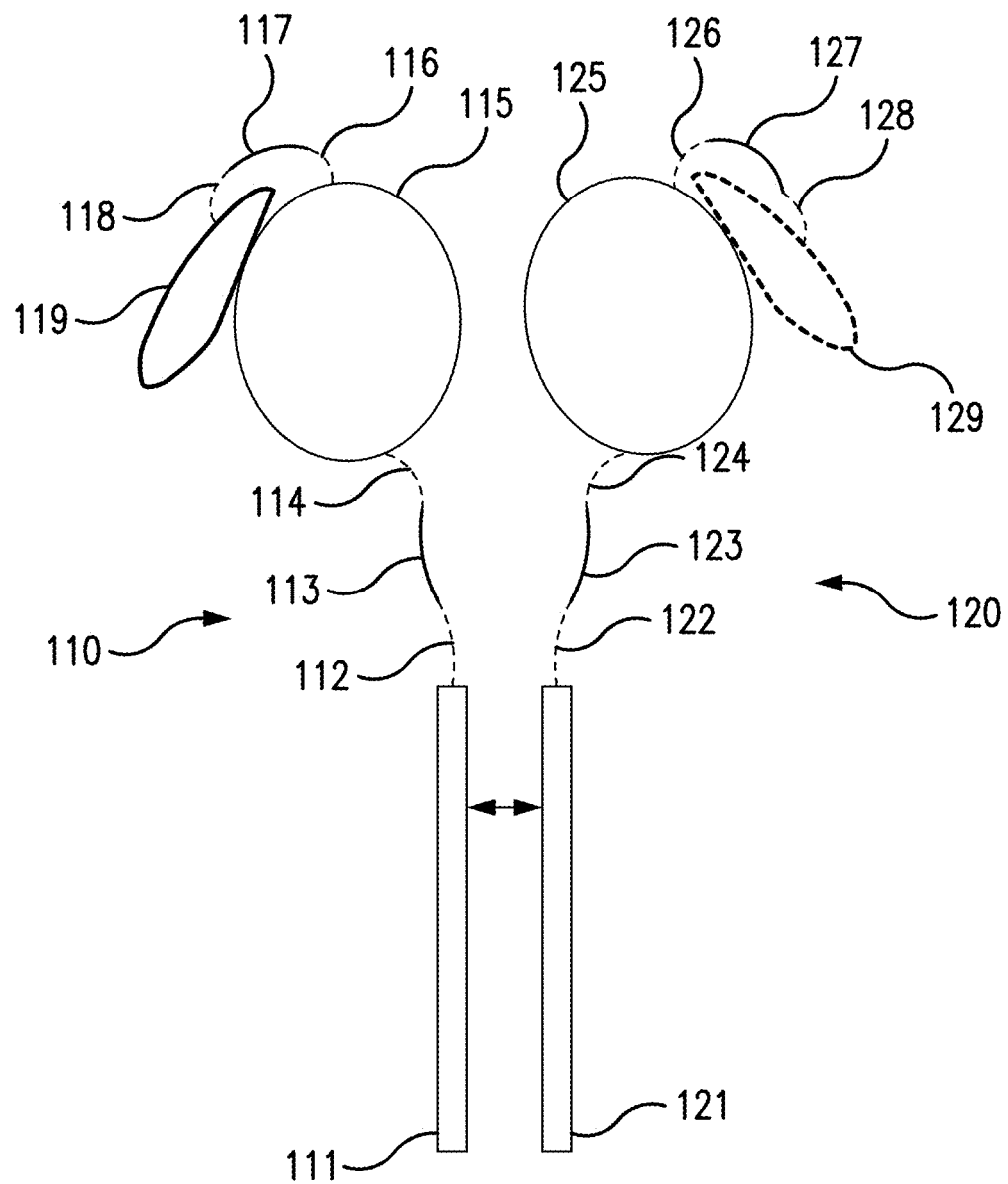
FIGS. 1-4 are schematics of illustrative activatable cytokine constructs.
Figure 2:
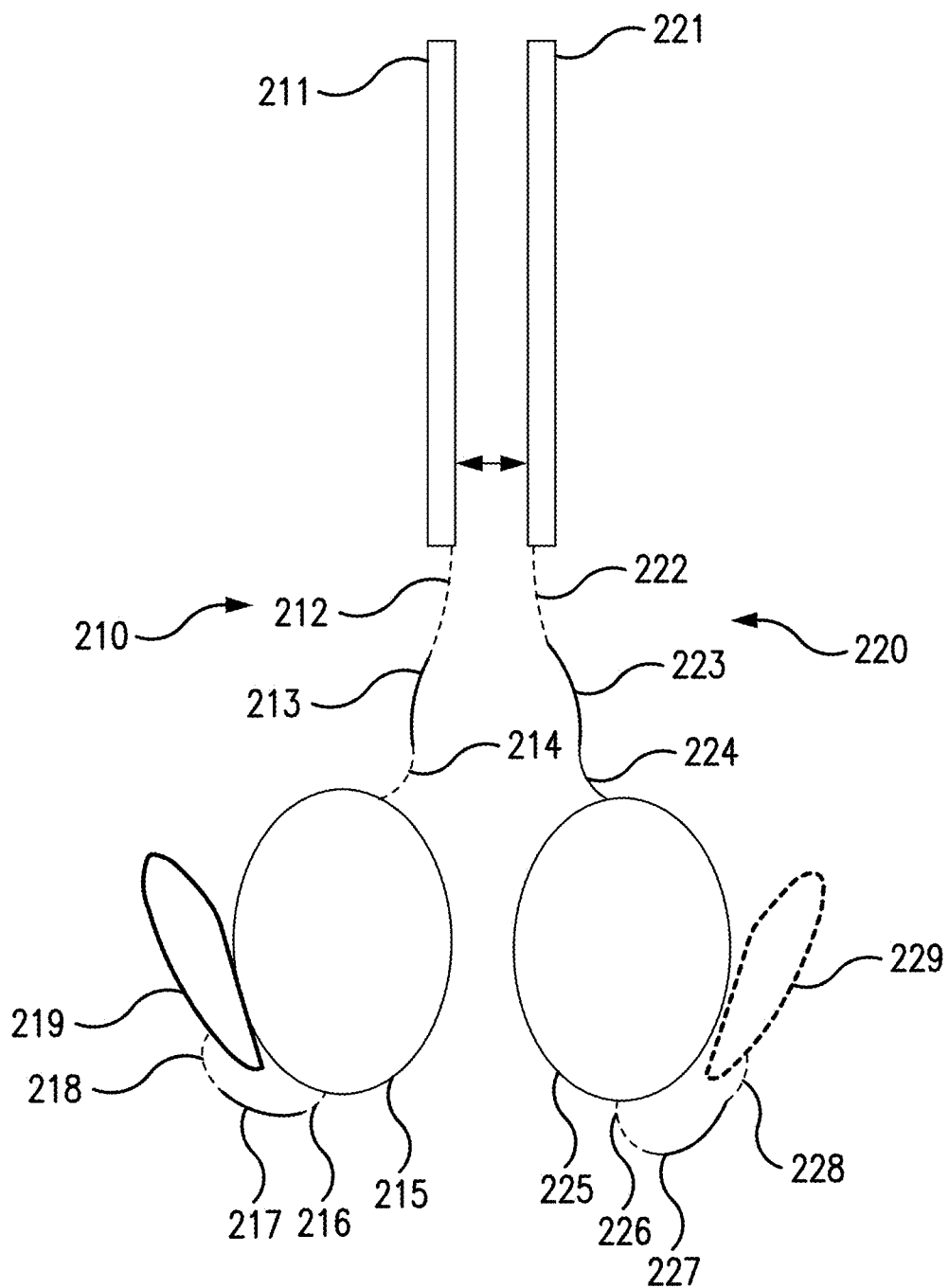
Figure 3:
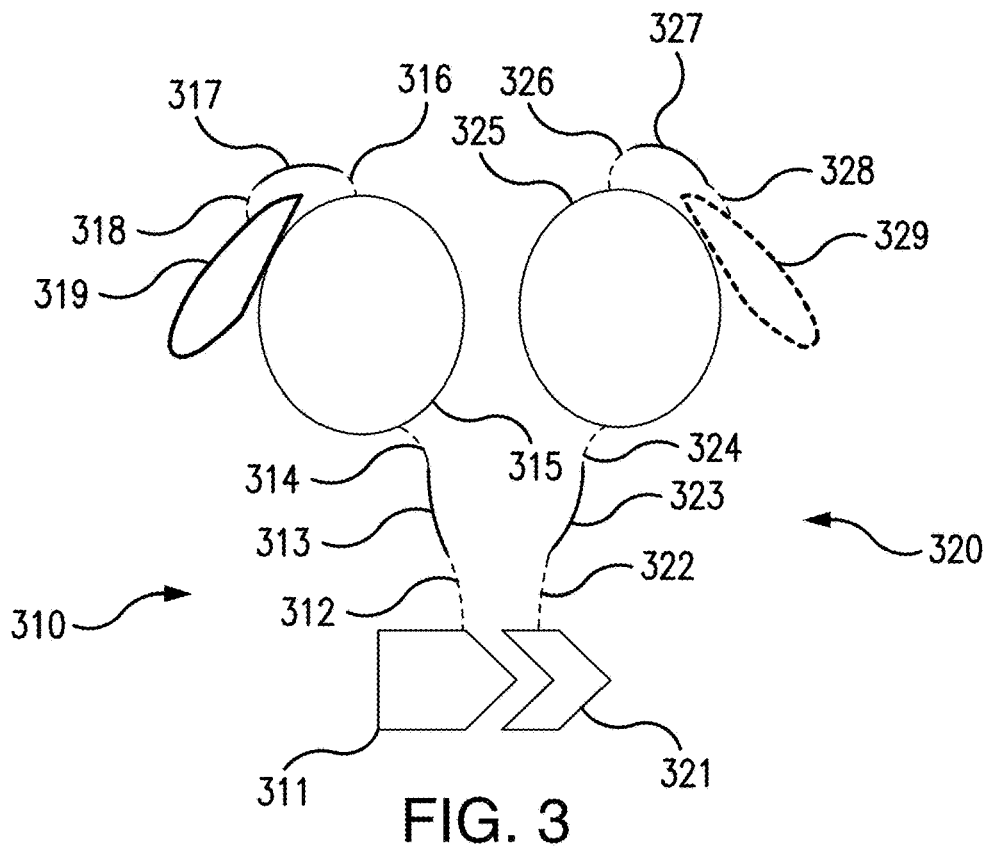
Figure 4:
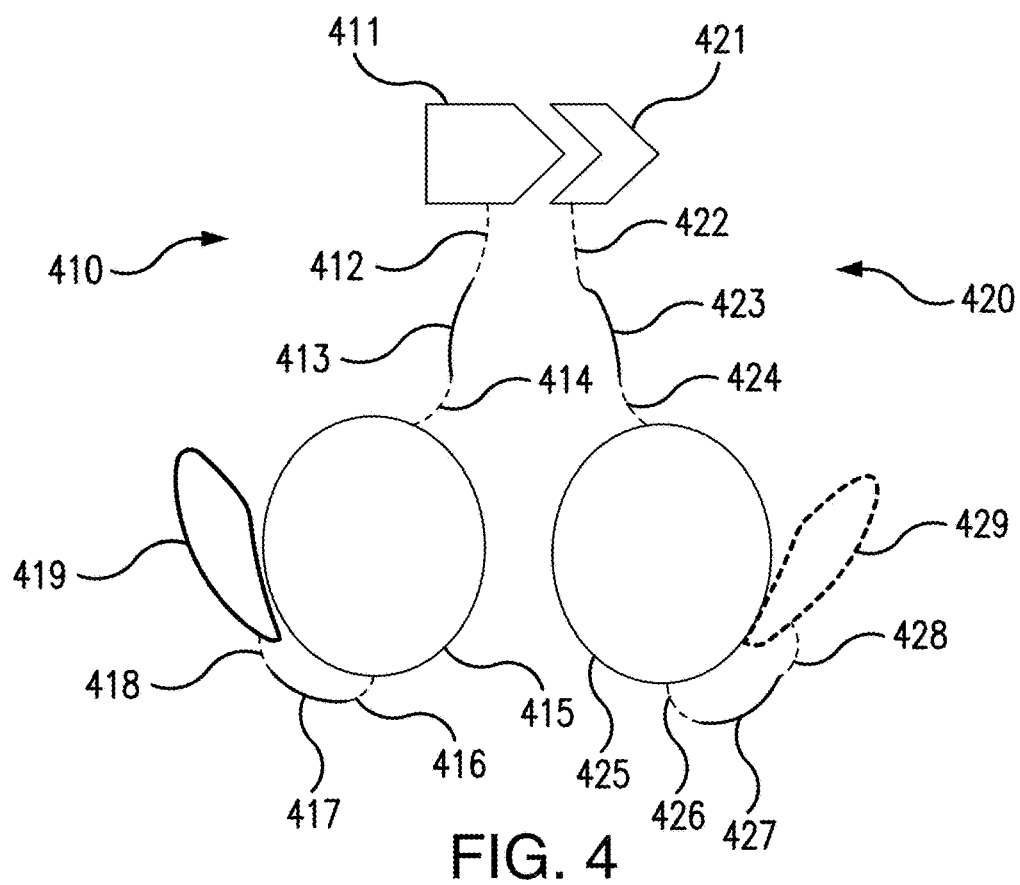
Figure 5:
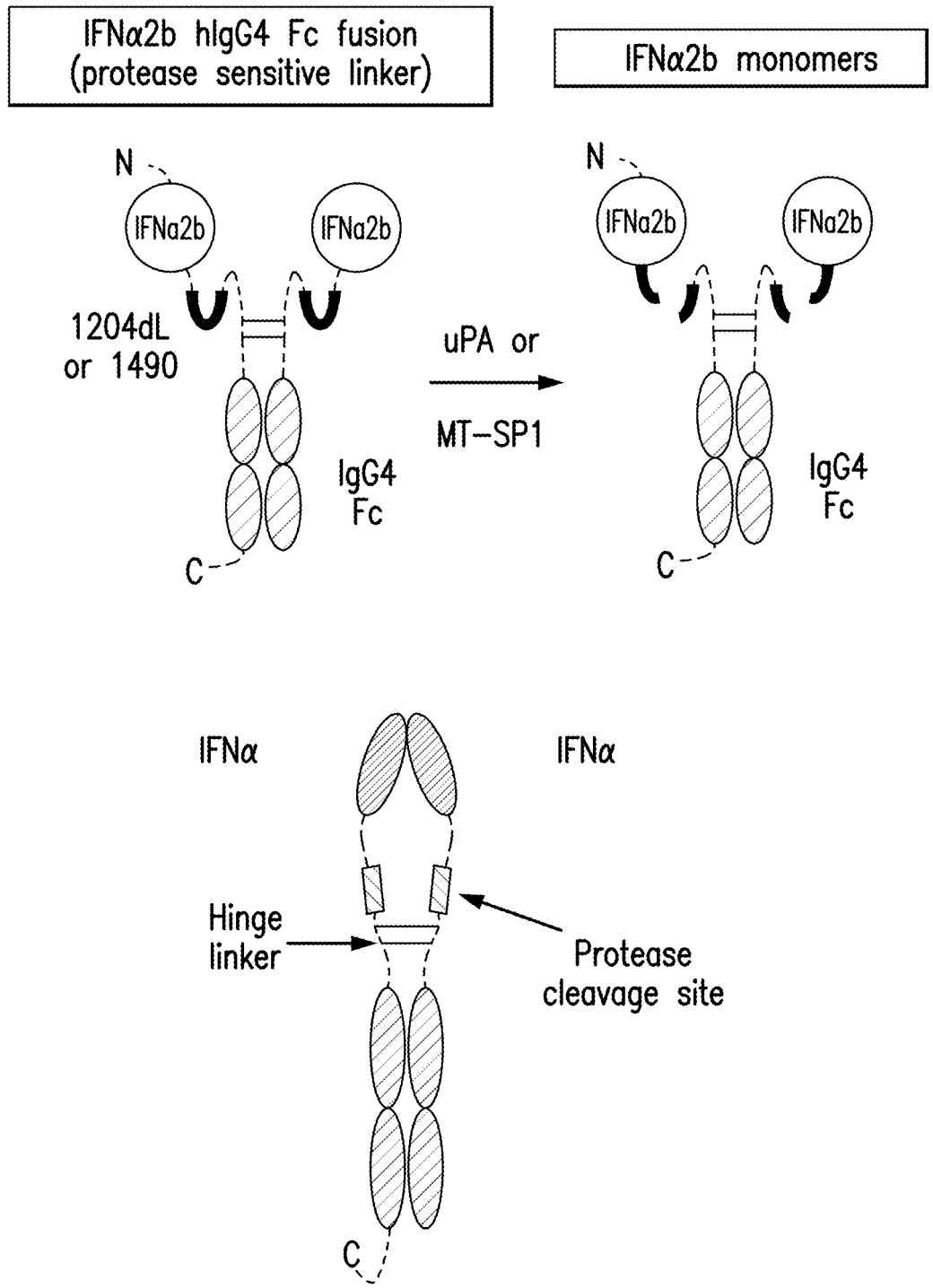
FIG. 5 depicts the cleavage reaction of a cytokine construct without a peptide mask, IFNα-2b-hIgG4 Fc (with either cleavable moiety 1204 dL or cleavable moiety 1490), and a protease (either uPA or MT-SP1), which generates monomeric mature IFNα-2b.

Provided herein are activatable cytokine constructs (ACCs) that exhibit a reduced level of at least one activity of the corresponding cytokine, but which, after exposure to an activation condition, yield a cytokine product having substantially restored activity. Activatable cytokine constructs of the present invention may be designed to selectively activate upon exposure to diseased tissue, and not in normal tissue. As such, these compounds have the potential for conferring the benefit of a cytokine-based therapy, with potentially less of the toxicity associated with certain cytokine-based therapies.

Also provided herein are related intermediates, compositions, kits, nucleic acids, and recombinant cells, as well as related methods, including methods of using and methods of producing any of the activatable cytokine constructs described herein.

The inventors have surprisingly found that ACCs having the specific elements and structural orientations described herein appear potentially effective in improving the safety and therapeutic index of cytokines in therapy, particularly for treating cancers. While cytokines are regulators of innate and adaptive immune system and have broad anti-tumor activity in pre-clinical models, their clinical success has been limited by systemic toxicity and poor systemic exposure to target tissues. The inventors have surprisingly found that ACCs having the specific elements and structural orientations described herein appear to reduce the systemic toxicity associated with cytokine therapeutics and improve targeting and exposure to target issues. As such, the present disclosure provides a method of reducing target-mediated drug disposition (TMDD) of cytokine therapeutics by administering ACCs having the specific elements and structural orientations described herein to a subject. As such, the invention solves the problem of sequestration of a significant fraction of the administered cytokine dose by normal tissues, which is a problem that limits the fraction of the dose available in the systemic circulation to reach the target tissues, e.g., cancerous tissue, in conventional cytokine therapeutics. The present cytokine constructs localizes target binding to tumor tissues, thereby maintaining potency, reducing side effects, enabling new target opportunities, improving the therapeutic window for validated targets, creating a therapeutic window for undruggable targets, and providing multiple binding modalities. The present disclosure enables safe and effective systemic delivery, thereby avoiding the dose-dependent toxicities of conventional systemic cytokine therapies, and also avoids a requirement for intra-tumoral injection. The present disclosure provides a means for imparting localized anti-viral activity, immunomodulatory activity, antiproliferative activity and pro-apoptotic activity. The inventors surprisingly found that dimerization of the first and second monomer constructs achieves high reduction of cytokine activity, and surprisingly discovered that the cytokine activity can be substantially reduced with very high masking efficiency by the addition of a peptide mask at the other terminus of the activatable construct. See, e.g., FIGS. 10A-10C.

Applicant's U.S. Provisional App. No. 63/008,542, filed Apr. 10, 2020, and U.S. Provisional App. No. 63/161,889 filed Mar. 16, 2021, which describe certain activatable cytokine constructs without an affinity peptide mask, are incorporated herein by reference in their entireties.

Activatable Cytokine Constructs

Activatable cytokine constructs (ACCs) of the present invention are dimer complexes comprising a first monomer construct and a second monomer construct. Dimerization of the monomeric components is facilitated by a pair of dimerization domains. In one aspect, each monomer construct includes a cytokine protein (CP), one or more cleavable moieties (CM), a dimerization domain (DD), and a peptide mask (PM). The present inventors unexpectedly found that ACC structures comprising both a dimerization domain and a peptide mask have improved masking efficiency to minimize or eliminate off-target effects and undesired activity and/or toxic side effects of cytokines.

In a specific embodiment, the present invention provides an activatable cytokine construct (ACC) that includes a first monomer construct and a second monomer construct, wherein:

(a) the first monomer construct comprises a first peptide mask (PM1), a first mature cytokine protein (CP1), a first and third cleavable moieties (CM1 and CM2), and a first dimerization domain (DD1), wherein the CM1 is positioned between the CP1 and the DD1 and the CM2 is positioned between the PM1 and the CP1; and (b) the second monomer construct comprises a second mature cytokine protein (CP2), a second cleavable moiety (CM3), and a second dimerization domain (DD2), wherein the CM3 is positioned between the CP2 and the DD2;

wherein the DD1 and the DD2 bind each other thereby forming a dimer of the first monomer construct and the second monomer construct; and wherein the ACC is characterized by having a reduced level of at least one CP1 and/or CP2 activity as compared to a control level of the at least one CP1 and/or CP2 activity. In some embodiments, the second monomer construct further comprises a second peptide mask (PM2) and a fourth cleavable moiety (CM4) positioned between the PM2 and the CP2. In some embodiments, the first monomer construct and the second monomer construct are identical and bind one another to form a homodimer. In other embodiments, at least one of the CP, CM, PM, or DD components in each of the first and second monomer constructs is not identical, and the first and second monomer constructs bind one another to form a heterodimer.

The term "activatable" when used in reference to a cytokine construct, refers to a cytokine construct that exhibits a first level of one or more activities, whereupon exposure to a condition that causes cleavage of one or more cleavable moieties results in the generation of a cytokine construct that exhibits a second level of the one or more activities, where the second level of activity is greater than the first level of activity. Non-limiting examples of an activities include any of the exemplary activities of a cytokine described herein or known in the art.

The term "mature cytokine protein" refers herein to a cytokine protein that lacks a signal sequence. A signal sequence is also referred to herein as a "signal peptide." A cytokine protein (CP) may be a mature cytokine protein or a cytokine protein with a signal peptide. Thus, the ACCs of the present disclosure may include a mature cytokine protein sequence in some aspects. In some aspects, the ACCs of the present disclosure may include a mature cytokine protein sequence and, additionally, a signal sequence. In some aspects, the ACCs of the present disclosure may include sequences disclosed herein, including or lacking the signal sequences recited herein. In some embodiments, a signal sequence is selected from the group consisting of SEQ ID NO: 242, SEQ ID NO: 243, and SEQ ID NO: 244.

The terms "cleavable moiety" and "CM" are used interchangeably herein to refer to a peptide, the amino acid sequence of which comprises a substrate for a sequence-specific protease. Cleavable moieties that are suitable for use as a CM include any of the protease substrates that are known the art. Exemplary cleavable moieties are described in more detail below.

The terms "peptide mask" and "PM" are used interchangeably herein to refer to an amino acid sequence of less than 50 amino acids that reduces or inhibits one or more activities of a cytokine protein. The PM may bind to the cytokine and limit the interaction of the cytokine with its receptor. In some embodiments, the PM is no more than 40 amino acids in length. In preferred embodiments, the PM is no more than 20 amino acids in length. In some embodiments, the PM is no more than 19, 18, 17, 16, or 15 amino acids in length. In some aspects, the PM has at least 13 amino acids (including any number from 13 to 49). In some aspects, the PM has at least 14 amino acids (including any number from 14 to 49). In some aspects, the PM has at least 15 amino acids (including any number from 15 to 49). In certain aspects, the number of amino acids in the PM may be counted as those amino acids that bind to the cytokine protein. For example, the PM excludes large polypeptides. For example, the PM is not a latency associated peptide. For example, the PM is not a cytokine. For example, the PM is not a receptor for a cytokine. For example, the PM is not a fragment of a receptor for a cytokine. In some aspects, the PM does not have an amino acid sequence that is at least 85% identical to a receptor for a cytokine. For example, the PM is not an albumin. For example, the PM excludes proteins or polypeptides having more than 50 amino acids. In some aspects, the PM excludes proteins or polypeptides having more than 25 amino acids. In some aspects, the PM excludes proteins or polypeptides having more than 20 amino acids. In some aspects, the PM excludes proteins or polypeptides having more than 15 amino acids. In some aspects, the PM does not include amino acids forming flexible N-terminal or C-terminal tail regions.

The terms "dimerization domain" and "DD" are used interchangeably herein to refer to one member of a pair of dimerization domains, wherein each member of the pair is capable of binding to the other via one or more covalent or non-covalent interactions. The first DD and the second DD may be the same or different. Exemplary DDs suitable for use as DD1 and or DD2 are described in more detail herein below.

As used herein, the term "linker" refers to a peptide, the amino acid sequence of which is not a substrate for a protease. Exemplary linkers are described in more detail below.

As used herein, the term "linking region" or "LR" refers to the stretch of amino acid residues between the C-terminus of the cytokine and the amino acid residue that is N-terminally adjacent to the proximal point of interaction between the dimerization domains (i.e., the linking region does not include the C-terminal amino acid of the cytokine or the N-terminal amino acid of the DD that forms the proximal point of interaction to the DD of the corresponding second monomer). For example, when the DDs are a pair of Fc domains, the linking region is the stretch of amino acid residues between the C-terminus of the cytokine and the first N-terminal cysteine residue of the Fc that participates in the disulfide linkage with the second Fc domain (e.g., Cysteine 226 of an IgG1 or IgG4 Fc domain, according to EU numbering). When the dimerization domain is not a polypeptide, then the linking region is the stretch of amino acid residues following the C-terminus of the cytokine until the last amino acid. For example, when the DDs are a biotin-streptavidin pair, the linking region of the biotin-containing monomer is the stretch of amino acid residues between the C-terminus of the cytokine and the biotin molecule, and the linking region of the streptavidin-containing monomer is the stretch of amino acid residues between the C-terminus of the cytokine and the streptavidin molecule.

As used herein, the term "mask linking region" or "MLR" refers to the stretch of amino acid residues between a PM and a CP. The MLR spans from the N-terminus of a CP to the C-terminus of a PM. Thus, the MLR may include a PM, a PM and a linker, or a PM and two linkers. In some aspects, the MLR spans 15 to 22 amino acids. In some aspects, the MLR spans 16 to 21 amino acids. In some aspects, the MLR spans 17 to 20 amino acids. In some aspects, the MLR spans 18 to 20 amino acids. In some aspects, the MLR spans 15, 16, 17, 18, 18, 20, 21, or 22 amino acids.

As used herein, the term "masking efficiency" refers to the activity (e.g., EC50) of the uncleaved ACC divided by the activity of a control cytokine, wherein the control cytokine may be either cleavage product of the ACC or the cytokine used as the CP of the ACC. An ACC having a reduced level of at least one CP1 and/or CP2 activity has a masking efficiency that is greater than 10. In some embodiments, the ACCs described herein have a masking efficiency that is greater than 10, greater than 100, greater than 1000, or greater than 5000.

As used herein, the term "spacer" refers herein to an amino acid residue or a peptide incorporated at a free terminus of the mature ACC, for example between the signal peptide and the N-terminus of the mature ACC. In some aspects, a spacer (or "header") may contain glutamine (Q) residues. In some aspects, residues in the spacer minimize aminopeptidase and/or exopeptidase action to prevent cleavage of N-terminal amino acids. Illustrative and non-limiting spacer amino acid sequences may comprise or consist of any of the following exemplary amino acid sequences: QGQSGS (SEQ ID NO: 246); GQSGS (SEQ ID NO: 247); QSGS (SEQ ID NO: 248); SGS; GS; S; QGQSGQG (SEQ ID NO: 249); GQSGQG (SEQ ID NO: 251); QSGQG (SEQ ID NO: 252); SGQG (SEQ ID NO: 253); GQG; QG; G; QGQSGQ (SEQ ID NO: 254); GQSGQ (SEQ ID NO: 255); QSGQ (SEQ ID NO: 256); QGQSG (SEQ ID NO: 257); QGQS (SEQ ID NO: 258); SGQ; GQ; and Q. In some embodiments, spacer sequences may be omitted.

As used herein, a polypeptide, such as a cytokine or an Fc domain, may be a wild-type polypeptide (e.g., a naturally-existing polypeptide) or a variant of the wild-type polypeptide. A variant may be a polypeptide modified by substitution, insertion, deletion and/or addition of one or more amino acids of the wild-type polypeptide, provided that the variant retains the basic function or activity of the wild-type polypeptide. In some examples, a variant may have altered (e.g., increased or decreased) function or activity comparing with the wild-type polypeptide. In some aspects, the variant may be a functional fragment of the wild-type polypeptide. The term "functional fragment" means that the sequence of the polypeptide (e.g., cytokine) may include fewer amino acids than the full-length polypeptide sequence, but sufficient polypeptide chain length to confer activity (e.g., cytokine activity).

The first and second monomer constructs may further comprise additional elements, such as, for example, one or more linkers, and the like. The additional elements are described below in more detail. The organization of the CP, CM, PM, and DD components in each of the first and second monomer constructs may be arranged in the same order in each monomer construct. The CP1, CM1, PM1, and DD1 components may be the same or different as compared to the corresponding CP2, CM2, PM2, and DD2, in terms of, for example, molecular weight, size, amino acid sequence of the CP, CM, and PM components (and the DD components in embodiments where the DD components are polypeptides), and the like. Thus, the resulting dimer may have symmetrical or asymmetrical monomer construct components.

In some embodiments, the first monomer construct comprises, from N- to C-terminus of the CP and CM components, the PM1, the CM3, the CP1, the CM1, and, linked directly or indirectly (via a linker) to the C-terminus of the CM1, the DD1. In other embodiments, the first monomer construct comprises from C- to N-terminus of the CP and CM components, the PM1, the CM3, the CP1, the CM1, and, linked directly or indirectly (via a linker) to the N-terminus of the CM1, the DD1. In some embodiments, the second monomer construct comprises, from N- to C-terminal terminus of the CP and CM components, the PM2, the CM4, the CP2, the PM2, the CM2, and, linked directly or indirectly (via a linker) to the C-terminus of the CM2, the DD2. In other embodiments, the second monomer construct comprises, from C- to N-terminus of the CP and CM components, the PM2, the CM4, the CP2, the PM2, the CM2, and, linked directly or indirectly (via a linker) to the N-terminus of the CM2, the DD2. In one example, the first monomer construct comprises a first polypeptide that comprises the PM1, the CM3, the CP1, the CM1, and the DD1. In one example, the second monomer construct comprises a second polypeptide that comprises the CP2, the CM2, and the DD2. In another example, second monomer construct comprises a second polypeptide that comprises the PM2, the CM4, the CP2, the CM2, and the DD2.

In some embodiments, the CP and DD components are linked by a linker that is not cleavable by a protease. For example, the CP and DD components may be linked by a non-cleavable substrate sequence (NSUB). In some embodiments, one of the first and second monomer constructs comprises a NSUB between the CP and DD, and the other comprises a CM between the CP and DD. In some aspects, the linker may be an amino acid substrate sequence that includes glycine and serine residues, but is not susceptible to protease cleavage. Examples of non-cleavable linker sequences include those described in U.S. Pat. No. 10,611, 845B2, which is incorporated by reference herein by its entirety. In such cases, the CP and/or the DD may have a cleavage site for a protease.

Examples of the ACCs in the present disclosure can be presented by the following formulae (in the form of monomer 1/monomer 2, from the N-terminus to the C-terminus in each monomer)

PM1-CM3-CP1-CM1-DD1/PM2-CM4-CP2-CM2-DD2
PM1-CM3-CP1-CM1-DD1/CP2-CM2-DD2
DD1-CM1-CP1-CM3-PM1/DD2-CM2-CP2-CM4-PM2
DD1-CM1-CP1-CM3-PM1/DD2-CM2-CP2

The ACCs may comprise one or more linkers between the components. For example, the ACCs may comprise one or more linkers between PM and CP, and/or between CP and DD. Thus, as used herein and unless otherwise stated, each dash (—) between the ACC components represents either a direct linkage or linkage via one or more linkers.

In some aspects, when the ACC has an orientation of N-PM-CM1-CP-CM2-DD-C, then the entire span of amino acids from the N-terminus of the ACC to the N-terminal amino acid of the cytokine is 17 to 71 amino acids in length. In some aspects, when the ACC has an orientation of N-DD-CM1-CP-CM2-PM-C, then the entire span of amino acids from the C-terminus of the ACC to the C-terminal amino acid of the cytokine is 17 to 71 amino acids in length.

In certain embodiments, the first and second monomeric constructs are oriented such that the components in each member of the dimer are organized in the same order from N-terminus to C-terminus of the CP and CM components. A schematic of an illustrative ACC is provided in FIG. 1. With reference to FIG. 1, the ACC comprises, from N-terminus to C-terminus: (1) a first monomer construct 110 having a PM1 119, a CM3 117, a CP1 115, a CM1 113, and a DD1 111, and; (2) a second monomer construct 120 having optionally a PM2 129 and a CM4 127, a CP2 125, a CM2 123, and a DD2 121; and (3) one or more covalent or non-covalent bonds (← →) bonding the first monomer construct 110 to the second monomer construct 120. The ACC may further comprise one or more of the optional linkers 112, 114, 116, 118, 122, 124, 126, and 128 between the components. In one example, DD1 111 and DD2 121 are the same. In another example, DD1 111 and DD2 121 are different.

A schematic of a further illustrative ACC, with its components organized in the reverse orientation of the ACC is provided in FIG. 2. With reference to FIG. 2, the ACC comprises, from N-terminus to C-terminus of the CP and CM components: (1) a first monomer construct 210 having a DD1 211, a CM1 213, a CP1 215, a CM3 217, and a PM1 219; (2) a second monomer construct 220 having a DD2 221, a CM2 223, a CP2 225, and optionally a CM4 227 and a PM2 229; and (3) one or more covalent or non-covalent bonds (← →) bonding the first monomer construct 210 to the second monomer construct 220. The ACC may further comprise one or more of the optional linkers 212, 214, 216, 218, 222, 224, 226, and 228 between the components. In one example, DD1 211 and DD2 221 are the same. In another example, DD1 211 and DD2 221 are different.

A schematic of another illustrative ACC is provided in FIG. 3. With reference to FIG. 3, the ACC comprises, from N-terminus to C-terminus: (1) a first monomer construct 310 having a PM1 319, a CM3 317, a CP1 315, a CM1 313, and a DD1 311; and (2) a second monomer construct 320 having a CP2 325, a CM2 323, and a DD2 321, and optionally a PM2 329 and a CM4 327. DD1 311 and DD2 321 are binding partners, e.g., a ligand/receptor pair or an antigen/antigen-binding peptide pair, so that DD1 and DD2 are covalently or non-covalently bound together. The ACC may further comprise one or more of the optional linkers 312, 314, 316, 318, 322, 324, 326, and 328 between the components. In one example, DD1 311 and DD2 321 are the same. In another example, DD1 311 and DD2 321 are different.

In alternative aspects, one of the two moieties depicted as CP1 315 and CP2 325 is a truncated cytokine protein that lacks cytokine activity. For example, either CP1 or CP2 may be a truncated interferon alpha 2b having the first 151 amino acids of wild-type interferon alpha 2b. In alternative aspects, one of the two moieties depicted as CP1 315 and CP2 325 is a mutated cytokine protein that lacks cytokine activity. For example, either CP1 or CP2 may be a truncated interferon alpha 2b having a L130P mutation (e.g., SEQ ID NO: 329). In alternative aspects, one of the two moieties depicted as CP1 315 and CP2 325 is a polypeptide sequence that lacks cytokine activity, e.g., a signal moiety and/or a stub sequence. In alternative aspects, a first one of the two moieties depicted as CP1 315 and CP2 325 is a polypeptide sequence that binds with high affinity to a second one of the two moieties depicted as CP1 315 and CP2 325 and reduces the cytokine activity of the second moiety as compared to the control level of the second moiety.

A schematic of another illustrative ACC, with its components organized in the reverse orientation, is provided in FIG. 4. With reference to FIG. 4, the ACC comprises, from N-terminus to C-terminus of the CP and CM components: (1) a first monomer construct 410 having a DD1 411, a CM1 413, a CP1 415, a CM3 417, and a PM1 419; and (2) a second monomer construct 420 having a DD2 421, a CM2 423, a CP2 425, and optionally a CM4 427 and a PM2 429. DD1 411 and DD2 421 are binding partners, e.g., a ligand/receptor pair or an antigen/antigen-binding peptide pair, so that DD1 and DD2 are covalently or non-covalently bound together. The ACC may further comprise one or more of the optional linkers 412, 414, 416, 418, 422, 424, 426, and 428 between the components. In one example, DD1 411 and DD2 421 are the same. In another example, DD1 411 and DD2 421 are different.

The ACC structure was discovered to be highly effective at reducing activity of the mature cytokine protein components in a way that does not lead to substantially impaired cytokine activity after activation. The CP's activity in the ACC may be reduced by both the structure of the ACC (e.g., the dimer structure) and the peptide mask(s) in the ACC. In some embodiments, the activation condition for the ACCs described herein is exposure to one or more proteases that can dissociate the CP from both the DD and the PM. For example, the one or more proteases may cleave the CM between the CP and the PM and the CM between the CP and the DD. As demonstrated in the Examples, activation of the ACC resulted in substantial recovery of cytokine activity. The results suggest that conformation of the cytokine components was not irreversibly altered within the context of the ACC. Significantly, the inventors have discovered that the present structure, utilizing both a dimerization domain and one or more peptide masks that have specific binding affinity for the cytokine protein appears to result in a substantial masking effect achieved over use of either a peptide mask alone or a dimerization domain alone.

The ACC may employ any of a variety of mature cytokine proteins, cleavable moieties, peptide masks, and dimerization domains as the CP1, CP2, CM1, CM2, CM3, CM4, PM1, PM2, DD1, and DD2, respectively. For example, any of a variety of mature cytokine proteins that are known in the art or sequence and/or truncation variants thereof, may be suitable for use as either or both CP1 and CP2 components of the ACC. The mature cytokine proteins, CP1 and CP2 may be the same or different. In certain specific embodiments, CP1 and CP2 are the same. In other embodiments, CP1 and CP2 are different. The ACC may comprise additional amino acid residues at either or both N- and/or C-terminal ends of the CP1 and/or CP2.

In some embodiments, the CP1 and/or the CP2 may each independently comprise a mature cytokine protein selected from the group of: an interferon (such as, for example, an interferon alpha, an interferon beta, an interferon gamma, an interferon tau, and an interferon omega), an interleukin (such as, for example, IL-1α, IL-1β, IL-1RA, IL-18, IL-2, IL-4, IL-7, IL-9, IL-13, IL-15, IL-3, IL-5, GM-CSF, IL-6, IL-11, IL-21), G-CSF, IL-12, LIF, OSM, IL-10, IL-20, IL-14, IL-16, IL-17, CD154, LT-β, TNF-α, TNF-β, 4-1BBL, APRIL, CD27, CD70, CD153, CD178, GITRL, LIGHT, OX40L, OX40, TALL-1, TRAIL, TWEAK, TRANCE, TGF-β1, TGF-β2, TGF-β3, EPOo, TPO, Flt-3L, SCF, M-CSF, and MSP, and the like, as well as sequence and truncation variants thereof. In particular, an ACC for use in combination may contain IL-2, IL-7, IL-8, IL-10, IL-12, IL-15, IL-21, an IFN-alpha, an IFN beta, an IFN gamma, GM-CSF, TGF-beta, LIGHT, GITR-L, CD40L, CD27L, 4-1BB-L, OX40, OX40L. For example, sequences of such proteins include those in Table 11 and additional examples of the sequences can be obtained from ncbi.nlm.nih.gov/protein. Truncation variants that are suitable for use in the ACCs of the present invention include any N- or C-terminally truncated cytokine that retains a cytokine activity. Exemplary truncation variants employed in the present invention include any of the truncated cytokine polypeptides that are known in the art (see, e.g., Slutzki et al., *J. Mol. Biol.* 360:1019-1030, 2006, and US 2009/0025106), as well as cytokine polypeptides that are N- and/or C-terminally truncated by 1 to about 40 amino acids, 1 to about 35 amino acids, 1 to about 30 amino acids, 1 to about 25 amino acids, 1 to about 20 amino acids, 1 to about 15 amino acids, 1 to about 10 amino acids, 1 to about 8 amino acids, 1 to about 6 amino acids, 1 to about 4 amino acids, that retain a cytokine activity. In some of the foregoing embodiments, the truncated CP is an N-terminally truncated CP. In other embodiments, the truncated CP is a C-terminally truncated CP. In certain embodiments, the truncated CP is a C- and an N-terminally truncated CP.

In some embodiments, the CP1 and/or the CP2 each independently comprise an amino acid sequence that is at least 80% identical (e.g., at least 82%, at least 84%, at least 86%, at least 88%, at least 90%, at least 92%, at least 94%, at least 95%, at least 96%, at least 97%, at least 98%, at least 99%, or 100% identical) to a cytokine reference sequence selected from the group consisting of: SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 12, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, and SEQ ID NO: 209. The percentage of sequence identity refers to the level of amino acid sequence identity between two or more peptide sequences when aligned using a sequence alignment program, e.g., the suite of BLAST programs, publicly available on the Internet at the NCBI website. See also Altschul et al., *J. Mol. Biol.* 215:403-10, 1990. In some aspects, the ACC includes an interferon alpha 2b mutant, for example, an interferon alpha 2b molecule having a mutation at position L130, e.g., L130P mutation relative to SEQ ID NO: 1 (e.g., SEQ ID NO: 329), as either CP1 or CP2. In some aspects, the ACC includes an interferon alpha 2b mutant having a mutation at position I24, F64, I60, I63, F64, W76, I116, L117, F123, or L128, or a combination thereof. For example, the interferon alpha 2b mutant may include mutations I116 to T, N. or R; L128 to N, H, or R; 124 to P or Q; L117H; or L128T, or a combination thereof. In some aspects, the interferon alpha 2b mutant may include mutations I24Q, I60T, F64A, W76H, I116R, and L128N, or a subset thereof. In some aspects, the ACC includes as one of CP1 and CP2 a truncated interferon alpha 2b molecule that lacks cytokine activity. For example, the truncated interferon alpha 2b may consist of 151 or fewer amino acids of interferon alpha 2b, e.g., any one of amino acids in the wild-type interferon alpha 2b sequence from N to C-terminus: 1 to 151, 1 to 150, 1 to 149, 1 to 148, . . . 1 to 10, 1 to 9, 1 to 8, 1 to 7, 1 to 6, or 2 to 151, 3 to 151, 4 to 151, 5 to 150, 6 to 149, 7 to 148, 8 to 147, or any intervening sequence of amino acids or mutants thereof.

In certain specific embodiments, the CP1 and/or the CP2 comprise an interferon. Interferons that are suitable for use in the constructs of the present invention as CP1 and/or CP2 include, for example, an interferon-alpha, an interferon-beta, an interferon-gamma, an interferon-omega, and an interferon-tau. In some embodiments, when the interferon is an interferon alpha, it may be an interferon alpha-2a, an interferon alpha-2b, or an interferon alpha-n3. Further examples of interferon alpha include interferon alpha-1, interferon alpha-4, interferon alpha-5, interferon alpha-6, interferon alpha-7, interferon alpha-8, interferon alpha-10, interferon alpha-13, interferon alpha-14, interferon alpha-16, interferon alpha-17, and interferon alpha-21. In some embodiments, the interferon is a recombinant or purified interferon alpha. In certain embodiments, when the interferon is an interferon-beta, it is selected from the group consisting of an interferon beta-1a and an interferon beta-1b. In some embodiments, the CP1 and/or the CP2 comprises an IFab domain, which is a conserved protein domain found in interferon alpha or interferon beta. The IFab domain is responsible for the cytokine release and antivirus functions of interferons. Exemplary IFab sequences are provided in SEQ ID Nos: 482-491. In one example, the CP1 and the CP2 are different interferons. In another example, the CP1 and the CP2 are the same interferon.

In some embodiments, the CP1 and/or the CP2 exhibit(s) an interferon activity and include(s) an amino acid sequence that is at least 80% identical, at least 82% identical, at least 84% identical, at least 86% identical, at least 88% identical, at least 90% identical, at least 92% identical, at least 94% identical, at least 96% identical, at least 98% identical, or at least 99% identical, or 100% identical to an interferon alpha reference sequence selected from the group consisting of SEQ ID NO: 1, SEQ ID NO: 101, SEQ ID NO: 102, SEQ ID NO: 103, SEQ ID NO: 104, and SEQ ID NO: 105. In certain specific embodiments, the interferon alpha reference sequence is SEQ ID NO: 1 (human interferon alpha-2b). In some embodiments, the CP1 and/or the CP2 comprise a mature alpha interferon having an amino acid sequence selected from the group consisting of SEQ ID NO: 1, SEQ ID NO: 101, SEQ ID NO: 102, SEQ ID NO: 103, SEQ ID NO: 104, and SEQ ID NO: 105. In certain embodiments, the CP1 and/or the CP2 comprise a mature human alpha interferon having the amino acid sequence of SEQ ID NO: 1. In some of the above-described embodiments, the CP1 and the CP2 comprise the same amino acid sequence.

In other embodiments, the CP1 and/or the CP2 exhibit(s) an interferon activity and include(s) an amino acid sequence that is at least 80% identical, at least 82% identical, at least 84% identical, at least 86% identical, at least 88% identical, at least 90% identical, at least 92% identical, at least 94% identical, at least 96% identical, at least 98% identical, or at least 99% identical, or 100% identical to an interferon beta reference sequence selected from the group consisting of SEQ ID NO: 106, SEQ ID NO: 107, SEQ ID NO: 108, and SEQ ID NO: 109. In certain embodiments, the interferon beta reference sequence is a human interferon beta reference sequence selected from the group consisting of SEQ ID NO: 106 and SEQ ID NO: 107. In some embodiments, the CP1 and/or the CP2 comprise a mature beta interferon having an amino acid sequence selected from the group consisting of SEQ ID NO: 106, SEQ ID NO: 107, SEQ ID NO: 108, and SEQ ID NO: 109. In some of the above-described embodiments, the CP1 and the CP2 comprise the same amino acid sequence.

In some embodiments, the CP1 and/or the CP2 exhibit(s) an interferon activity and include(s) an amino acid sequence that is at least 80% identical, at least 82% identical, at least 84% identical, at least 86% identical, at least 88% identical, at least 90% identical, at least 92% identical, at least 94% identical, at least 96% identical, at least 98% identical, or at least 99% identical, or 100% identical to an interferon omega reference sequence corresponding to SEQ ID NO: 110 (human interferon omega). In certain specific embodiments, the CP1 and/or CP2 comprise a mature human omega interferon having the amino acid sequence of SEQ ID NO: 110. In some of the above-described embodiments, the CP1 and the CP2 comprise the same amino acid sequence.

In some embodiments, the CP1 and/or the CP2 exhibit(s) an interleukin activity and include(s) an amino acid sequence that is at least 80% identical, at least 82%, at least 84%, at least 86%, at least 88%, at least 90%, at least 92%, at least 94%, at least 95%, at least 96%, at least 97%, at least 98%, or at least 99% identical or 100% identical to an interleukin reference sequence selected from the group consisting of: SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 12, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 143, SEQ ID NO: 144, SEQ ID NO: 145, SEQ ID NO: 146, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, and SEQ ID NO: 160. In some embodiments, CP1 and/or CP2 comprises a mature interleukin having an amino acid sequence selected from the group consisting of: SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 12, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 143, SEQ ID NO: 144, SEQ ID NO: 145, SEQ ID NO: 146, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, and SEQ ID NO: 160. In some of the above-described embodiments, the CP1 and the CP2 comprise the same amino acid sequence.

In some embodiments, CP1 and/or CP2 exhibit(s) an interleukin activity and include(s) an amino acid sequence that is at least 80% identical, at least 82%, at least 84%, at least 86%, at least 88%, at least 90%, at least 92%, at least 94%, at least 95%, at least 96%, at least 97%, at least 98%, or at least 99% identical to an interleukin reference sequence selected from the group consisting of SEQ ID NO: 111 (human IL-1 alpha), SEQ ID NO: 113 (human IL-1 beta), SEQ ID NO: 115 (human IL-1RA), SEQ ID NO: 117 (human IL-18), SEQ ID NO: 119 (human IL-2), SEQ ID NO: 121 (human IL-4), SEQ ID NO: 123 (human IL-7), SEQ ID NO: 125 (human IL-9), SEQ ID NO: 127 (human IL-13), SEQ ID NO: 129 (human IL-15), SEQ ID NO: 131 (human IL-3), SEQ ID NO: 133 (human IL-5), SEQ ID NO: 137 (human IL-6), SEQ ID NO: 139 (human IL-11), SEQ ID NO: 143 (human IL-12 alpha), SEQ ID NO: 144 (human IL-12 beta), SEQ ID NO: 151 (human IL-10), SEQ ID NO: 153 (human IL-20); SEQ ID NO: 155 (human IL-14), SEQ ID NO: 157 (human IL-16), and SEQ ID NO: 159 (human IL-17). In certain of these embodiments, CP1 and/or CP2 comprise an amino acid sequence from the group consisting of SEQ ID NO: 111 (human IL-1 alpha), SEQ ID NO: 113 (human IL-1 beta), SEQ ID NO: 115 (human IL-1RA), SEQ ID NO: 117 (human IL-18), SEQ ID NO: 119 (human IL-2), SEQ ID NO: 121, SEQ ID NO: 123 (human IL-7), SEQ ID NO: 125 (human IL-9), SEQ ID NO: 127 (human IL-13), SEQ ID NO: 129 (human IL-15), SEQ ID NO: 131 (human IL-3), SEQ ID NO: 133 (human IL-5), SEQ ID NO: 137 (human IL-6), SEQ ID NO: 139 (human IL-11), SEQ ID NO: 143 (human IL-12 alpha), SEQ ID NO: 144 (human IL-12 beta), SEQ ID NO: 151 (human IL-10), SEQ ID NO: 153 (human IL-20); SEQ ID NO: 155 (human IL-14), SEQ ID NO: 157 (human IL-16), and SEQ ID NO: 159 (human IL-17). In some of the above-described embodiments, the CP1 and the CP2 comprise the same amino acid sequence.

The number of amino acids in the sequence of the cytokine proteins employed may vary, depending on the specific cytokine protein employed. In some embodiments, the CP1 and/or the CP2 includes a total of about 10 amino acids to about 700 amino acids, about 10 amino acids to about 650 amino acids, about 10 amino acids to about 600 amino acids, about 10 amino acids to about 550 amino acids, about 10 amino acids to about 500 amino acids, about 10 amino acids to about 450 amino acids, about 10 amino acids to about 400 amino acids, about 10 amino acids to about 350 amino acids, about 10 amino acids to about 300 amino acids, about 10 amino acids to about 250 amino acids, about 10 amino acids to about 200 amino acids, about 10 amino acids to about 150 amino acids, about 10 amino acids to about 100 amino acids, about 10 amino acids to about 80 amino acids, about 10 amino acids to about 60 amino acids, about 10 amino acids to about 40 amino acids, about 10 amino acids to about 20 amino acids, about 20 amino acids to about 700 amino acids, about 20 amino acids to about 650 amino acids, about 20 amino acids to about 600 amino acids, about 20 amino acids to about 550 amino acids, about 20 amino acids to about 500 amino acids, about 20 amino acids to about 450 amino acids, about 20 amino acids to about 400 amino acids, about 20 amino acids to about 350 amino acids, about 20 amino acids to about 300 amino acids, about 20 amino acids to about 250 amino acids, about 20 amino acids to about 200 amino acids, about 20 amino acids to about 150 amino acids, about 20 amino acids to about 100 amino acids, about 20 amino acids to about 80 amino acids, about 20 amino acids to about 60 amino acids, about 20 amino acids to about 40 amino acids, about 40 amino acids to about 700 amino acids, about 40 amino acids to about 650 amino acids, about 40 amino acids to about 600 amino acids, about 40 amino acids to about 550 amino acids, about 40 amino acids to about 500 amino acids, about 40 amino acids to about 450 amino acids, about 40 amino acids to about 400 amino acids, about 40 amino acids to about 350 amino acids, about 40 amino acids to about 300 amino acids, about 40 amino acids to about 250 amino acids, about 40 amino acids to about 200 amino acids, about 40 amino acids to about 150 amino acids, about 40 amino acids to about 100 amino acids, about 40 amino acids to about 80 amino acids, about 40 amino acids to about 60 amino acids, about 60 amino acids to about 700 amino acids, about 60 amino acids to about 650 amino acids, about 60 amino acids to about 600 amino acids, about 60 amino acids to about 550 amino acids, about 60 amino acids to about 500 amino acids, about 60 amino acids to about 450 amino acids, about 60 amino acids to about 400 amino acids, about 60 amino acids to about 350 amino acids, about 60 amino acids to about 300 amino acids, about 60 amino acids to about 250 amino acids, about 60 amino acids to about 200 amino acids, about 60 amino acids to about 150 amino acids, about 60 amino acids to about 100 amino acids, about 60 amino acids to about 80 amino acids, about 80 amino acids to about 700 amino acids, about 80 amino acids to about 650 amino acids, about 80 amino acids to about 600 amino acids, about 80 amino acids to about 550 amino acids, about 80 amino acids to about 500 amino acids, about 80 amino acids to about 450 amino acids, about 80 amino acids to about 400 amino acids, about 80 amino acids to about 350 amino acids, about 80 amino acids to about 300 amino acids, about 80 amino acids to about 250 amino acids, about 80 amino acids to about 200 amino acids, about 80 amino acids to about 150 amino acids, about 80 amino acids to about 100 amino acids, about 100 amino acids to about 700 amino acids, about 100 amino acids to about 650 amino acids, about 100 amino acids to about 600 amino acids, about 100 amino acids to about 550 amino acids, about 100 amino acids to about 500 amino acids, about 100 amino acids to about 450 amino acids, about 100 amino acids to about 400 amino acids, about 100 amino acids to about 350 amino acids, about 100 amino acids to about 300 amino acids, about 100 amino acids to about 250 amino acids, about 100 amino acids to about 200 amino acids, about 100 amino acids to about 150 amino acids, about 150 amino acids to about 700 amino acids, about 150 amino acids to about 650 amino acids, about 150 amino acids to about 600 amino acids, about 150 amino acids to about 550 amino acids, about 150 amino acids to about 500 amino acids, about 150 amino acids to about 450 amino acids, about 150 amino acids to about 400 amino acids, about 150 amino acids to about 350 amino acids, about 150 amino acids to about 300 amino acids, about 150 amino acids to about 250 amino acids, about 150 amino acids to about 200 amino acids, about 200 amino acids to about 700 amino acids, about 200 amino acids to about 650 amino acids, about 200 amino acids to about 600 amino acids, about 200 amino acids to about 550 amino acids, about 200 amino acids to about 500 amino acids, about 200 amino acids to about 450 amino acids, about 200 amino acids to about 400 amino acids, about 200 amino acids to about 350 amino acids, about 200 amino acids to about 300 amino acids, about 200 amino acids to about 250 amino acids, about 250 amino acids to about 700 amino acids, about 250 amino acids to about 650 amino acids, about 250 amino acids to about 600 amino acids, about 250 amino acids to about 550 amino acids, about 250 amino acids to about 500 amino acids, about 250 amino acids to about 450 amino acids, about 250 amino acids to about 400 amino acids, about 250 amino acids to about 350 amino acids, about 250 amino acids to about 300 amino acids, about 300 amino acids to about 700 amino acids, about 300 amino acids to about 650 amino acids, about 300 amino acids to about 600 amino acids, about 300 amino acids to about 550 amino acids, about 300 amino acids to about 500 amino acids, about 300 amino acids to about 450 amino acids, about 300 amino acids to about 400 amino acids, about 300 amino acids to about 350 amino acids, about 350 amino acids to about 700 amino acids, about 350 amino acids to about 650 amino acids, about 350 amino acids to about 600 amino acids, about 350 amino acids to about 550 amino acids, about 350 amino acids to about 500 amino acids, about 350 amino acids to about 450 amino acids, about 350 amino acids to about 400 amino acids, about 400 amino acids to about 700 amino acids, about 400 amino acids to about 650 amino acids, about 400 amino acids to about 600 amino acids, about 400 amino acids to about 550 amino acids, about 400 amino acids to about 500 amino acids, about 400 amino acids to about 450 amino acids, about 450 amino acids to about 700 amino acids, about 450 amino acids to about 650 amino acids, about 450 amino acids to about 600 amino acids, about 450 amino acids to about 550 amino acids, about 450 amino acids to about 500 amino acids, about 500 amino acids to about 700 amino acids, about 500 amino acids to about 650 amino acids, about 500 amino acids to about 600 amino acids, about 500 amino acids to about 550 amino acids, about 550 amino acids to about 700 amino acids, about 550 amino acids to about 650 amino acids, about 550 amino acids to about 600 amino acids, about 600 amino acids to about 700 amino acids, about 600 amino acids to about 650 amino acids, or about 650 amino acids to about 700 amino acids. In some embodiments, CP1 and/or the CP2 is a mature wildtype human cytokine protein.

Each monomer construct of the ACC may employ any of a variety of dimerization domains. Suitable DDs include both polymeric (e.g., a synthetic polymer, a polypeptide, a polynucleotide, and the like) and small molecule (non-polymeric moieties having a molecular weight of less than about 1 kilodalton, and sometimes less than about 800 daltons) types of moieties. The pair of DDs may be any pair of moieties that are known in the art to bind to each other.

For example, in some embodiments, the DD1 and the DD2 are members of a pair selected from the group of: a sushi domain from an alpha chain of human IL-15 receptor (IL15Ra) and a soluble IL-15; barnase and barnstar; a protein kinase A (PKA) and an A-kinase anchoring protein (AKAP); adapter/docking tag molecules based on mutated RNase I fragments; a pair of antigen-binding domains (e.g., a pair of single domain antibodies); soluble N-ethyl-maleimide sensitive factor attachment protein receptors (SNARE); modules based on interactions of the proteins syntaxin, synaptotagmin, synaptobrevin, and SNAP25; a single domain antibody (sdAb) and corresponding epitope; an antigen-binding domain (e.g., a single chain antibody such as a single chain variable fragment (scFv), a single domain antibody, and the like) and a corresponding epitope; coiled coil polypeptide structions (e.g., Fos-Jun coiled coil structures, acid/base coiled-coil helices, Glu-Lys coiled coil helices, leucine zipper structures), small molecule binding pairs such as biotin and avidin or streptavidin, amine/aldehyde, lectin/carbohydrate; a pair of polymers that can bind each other, such as, for example, a pair of sulfur- or thiol-containing polymers (e.g., a pair of Fc domains, a pair of thiolized-human serum albumin polypeptides, and the like); and the like.

In some embodiments, the DD1 and DD2 are non-polypeptide polymers. The non-polypeptide polymers may covalently bound to each other. In some examples, the non-polypeptide polymers may be a sulfur-containing polymer, e.g., sulfur-containing polyethylene glycol. In such cases, the DD1 and DD2 may be covalently bound to each other via one or more disulfide bonds.

When the pair of DD1 and DD2 are members of a pair of epitope and antigen-binding domain, the epitope may be a naturally or non-naturally occurring epitope. Exemplary non-naturally occurring epitopes include, for example, a non-naturally occurring peptide, such as, for example, a poly-His peptide (e.g., a His tag, and the like).

In certain specific embodiments, the DD1 and the DD2 are a pair of Fc domains. As used herein, an "Fc domain" refers to a contiguous amino acid sequence of a single heavy chain of an immunoglobulin, e.g., the CH2-CH3 domains of IgG, IgA, or IgD, or the CH2-CH3-CH4 domains of IgE or IgM. A pair of Fc domains associate together to form an Fc region of an immunoglobulin.

In some embodiments, the pair of Fc domains is a pair of human Fc domains (e.g., a pair of wildtype human Fc domains). In some embodiments, the human Fc domains are human IgG1 Fc domains (e.g., wildtype human IgG1 Fc domains), human IgG2 Fc domains (e.g., wildtype human IgG2 Fc domains), human IgG3 Fc domains (e.g., wildtype human IgG3 Fc domains), or human IgG4 Fc domains (e.g., wildtype human IgG4 Fc domains). In some embodiments, the human Fc domains comprise a sequence that is at least 80% identical (e.g., at least 82%, at least 84%, at least 85%, at least 86%, at least 88%, at least 90%, at least 92%, at least 94%, at least 95%, at least 96%, at least 97%, at least 98%, at least 99%, or 100% identical) to SEQ ID NO: 3.

In some embodiments, the pair of Fc domains comprise a knob mutant and a hole mutant of a Fc domain. The knob and hole mutants may interact with each other to facilitate the dimerization. In some embodiments, the knob and hole mutants may comprise one or more amino acid modifications within the interface between two Fc domains (e.g., in the CH3 domain). In one example, the modifications comprise amino acid substitution T366W and optionally the amino acid substitution S354C in one of the antibody heavy chains, and the amino acid substitutions T366S, L368A, Y407V and optionally Y349C in the other one of the antibody heavy chains (numbering according to EU index of Kabat numbering system). Examples of the knob and hole mutants include Fc mutants of SEQ ID NOs: 318 and 319, as well as those described in U.S. Pat. Nos. 5,731,168; 7,695,936; and 10,683,368, which are incorporated herein by reference in their entireties. In some embodiments, the dimerization domains comprise a sequence that is at least 80% identical (e.g., at least 82%, at least 84%, at least 85%, at least 86%, at least 88%, at least 90%, at least 92%, at least 94%, at least 95%, at least 96%, at least 97%, at least 98%, at least 99%, or 100% identical) to SEQ ID NOs: 318 and 319, respectively.

In some embodiments, DD1 and/or DD2 can further include a serum half-life extending moiety (e.g., polypeptides that bind serum proteins, such as immunoglobulin (e.g., IgG) or serum albumin (e.g., human serum albumin (HSA)). Examples of half-life extending moieties include hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, and VSV Epitope.

In some embodiments, DD1 and/or DD2 each include a total of about 5 amino acids to about 250 amino acids, about 5 amino acids to about 200 amino acids, about 5 amino acids to about 180 amino acids, about 5 amino acids to about 160 amino acids, about 5 amino acids to about 140 amino acids, about 5 amino acids to about 120 amino acids, about 5 amino acids to about 100 amino acids, about 5 amino acids to about 80 amino acids, about 5 amino acids to about 60 amino acids, about 5 amino acids to about 40 amino acids, about 5 amino acids to about 20 amino acids, about 5 amino acids to about 10 amino acids, about 10 amino acids to about 250 amino acids, about 10 amino acids to about 200 amino acids, about 10 amino acids to about 180 amino acids, about 10 amino acids to about 160 amino acids, about 10 amino acids to about 140 amino acids, about 10 amino acids to about 120 amino acids, about 10 amino acids to about 100 amino acids, about 10 amino acids to about 80 amino acids, about 10 amino acids to about 60 amino acids, about 10 amino acids to about 40 amino acids, about 10 amino acids to about 20 amino acids, about 20 amino acids to about 250 amino acids, about 20 amino acids to about 200 amino acids, about 20 amino acids to about 180 amino acids, about 20 amino acids to about 160 amino acids, about 20 amino acids to about 140 amino acids, about 20 amino acids to about 120 amino acids, about 20 amino acids to about 100 amino acids, about 20 amino acids to about 80 amino acids, about 20 amino acids to about 60 amino acids, about 20 amino acids to about 40 amino acids, about 40 amino acids to about 250 amino acids, about 40 amino acids to about 200 amino acids, about 40 amino acids to about 180 amino acids, about 40 amino acids to about 160 amino acids, about 40 amino acids to about 140 amino acids, about 40 amino acids to about 120 amino acids, about 40 amino acids to about 100 amino acids, about 40 amino acids to about 80 amino acids, about 40 amino acids to about 60 amino acids, about 60 amino acids to about 250 amino acids, about 60 amino acids to about 200 amino acids, about 60 amino acids to about 180 amino acids, about 60 amino acids to about 160 amino acids, about 60 amino acids to about 140 amino acids, about 60 amino acids to about 120 amino acids, about 60 amino acids to about 100 amino acids, about 60 amino acids to about 80 amino acids, about 80 amino acids to about 250 amino acids, about 80 amino acids to about 200 amino acids, about 80 amino acids to about 180 amino acids, about 80 amino acids to about 160 amino acids, about 80 amino acids to about 140 amino acids, about 80 amino acids to about 120 amino acids, about 80 amino acids to about 100 amino acids, about 100 amino acids to about 250 amino acids, about 100 amino acids to about 200 amino acids, about 100 amino acids to about 180 amino acids, about 100 amino acids to about 160 amino acids, about 100 amino acids to about 140 amino acids, about 100 amino acids to about 120 amino acids, about 120 amino acids to about 250 amino acids, about 120 amino acids to about 200 amino acids, about 120 amino acids to about 180 amino acids, about 120 amino acids to about 160 amino acids, about 120 amino acids to about 140 amino acids, about 140 amino acids to about 250 amino acids, about 140 amino acids to about 200 amino acids, about 140 amino acids to about 180 amino acids, about 140 amino acids to about 160 amino acids, about 160 amino acids to about 250 amino acids, about 160 amino acids to about 200 amino acids, about 160 amino acids to about 180 amino acids, about 180 amino acids to about 250 amino acids, about 180 amino acids to about 200 amino acids, or about 200 amino acids to about 250 amino acids. In some embodiments, DD1 and DD2 are each an Fc domain that comprises a portion of the hinge region that includes two cysteine residues, a CH2 domain, and a CH3 domain. In some embodiments, DD1 and DD2 are each an Fc domain whose N-terminus is the first cysteine residue (reading in the N- to C-direction) in the hinge region that participates in a disulfide linkage with a second Fc domain (e.g., Cysteine 226 of human IgG1 or IgG4, using EU numbering).

In some aspects, positioned between the CP and the DD, and/or between the CP and the PM components, either directly or indirectly (e.g., via a linker), is a cleavable moiety that comprises a substrate for a protease. In some embodiments, the CMs may each independently comprise a substrate for a protease selected from the group consisting of ADAM8, ADAM9, ADAM10, ADAM12, ADAM15, ADAM17/TACE, ADEMDEC1, ADAMTS1, ADAMTS4, ADAMTS5, BACE, Renin, Cathepsin D, Cathepsin E, Caspase 1, Caspase 2, Caspase 3, Caspase 4, Caspase 5, Caspase 6, Caspase 7, Caspase 8, Caspase 9, Caspase 10, Caspase 14, Cathepsin A, Cathepsin B, Cathepsin C, Cathepsin G, Cathepsin K, Cathepsin L, Cathepsin S, Cathepsin V/L2, Cathepsin X/Z/P, Chymase, Cruzipain, DESC1, DPP-4, FAP, Legumain, Otubain-2, Elastase, FVIIa, FiXA, FXa, FXIa, FXIIa, Granzyme B, Guanidinobenzoatase, Hepsin, HtrA1, Human Neutrophil Elastase, KLK4, KLK5, KLK6, KLK7, KLK8, KLK10, KLK11, KLK13, KLK14, Lactoferrin, Marapsin, Matriptase-2, Meprin, MT-SP1/Matriptase, Neprilysin, NS3/4A, PACE4, Plasmin, PSMA, PSA, BMP-1, MMP1, MMP2, MMP3, MMP7, MMP8, MMP9, MMP10, MMP11, MMP12, MMP13, MMP14, MMP15, MMP16, MMP17, MMP19, MMP20, MMP23, MMP24, MMP26, MMP27, TMPRSS2, TMPRSS3, TMPRSS4, tPA, Thrombin, Tryptase, and uPA, and any combination of two or more thereof.

In some embodiments of any of the ACCs described herein, the protease that cleaves any of the CMs described herein can be ADAMS, ADAMS, ADAM10, ADAM12, ADAM15, ADAM17/TACE, ADAMDEC1, ADAMTS1, ADAMTS4, ADAMTS5, BACE, Renin, Cathepsin D, Cathepsin E, Caspase 1, Caspase 2, Caspase 3, Caspase 4, Caspase 5, Caspase 6, Caspase 7, Caspase 8, Caspase 9, Caspase 10, Caspase 14, Cathepsin B, Cathepsin C, Cathepsin K, Cathepsin L, Cathepsin S, Cathepsin V/L2, Cathepsin X/Z/P, Cruzipain, Legumain, Otubain-2, KLK4, KLK5, KLK6, KLK7, KLK8, KLK10, KLK11, KLK13, KLK14, Meprin, Neprilysin, PSMA, BMP-1, MMP-1, MMP-2, MMP-3, MMP-7, MMP-9, MMP-10, MMP-11, MMP-12, MMP-13, MMP-14, MMP-15, MMP-16, MMP-17, MMP-19, MMP-20, MMP-23, MMP-24, MMP-26, MMP-27, activated protein C, cathepsin A, cathepsin G, Chymase, FVIIa, FIXa, FXa, FXIa, FXIIa, Elastase, Granzyme B, Guanidinobenzoatase, HtrA1, human neutrophil lyase, lactoferrin, marapsin, NS3/4A, PACE4, Plasmin, PSA, tPA, thrombin, tryptase, uPA, DESC1, DPP-4, FAP, Hepsin, Matriptase-2, MT-SP1/Matripase, TMPRSS2, TMPRSS3, and TMPRSS4, and any combination of two or more thereof.

In some embodiments of any of the ACCs described herein, the protease is selected from the group of: uPA, legumain, MT-SP1, ADAM17, BMP-1, TMPRSS3, TMPRSS4, MMP-2, MMP-9, MMP-12, MMP-13, and MMP-14.

Increased levels of proteases having known substrates have been reported in a number of cancers. See, e.g., La Roca et al., *British J. Cancer* 90(7):1414-1421, 2004. Substrates suitable for use in the CMs components employed herein include those which are more prevalently found in cancerous cells and tissue. Thus, in certain embodiments, CMs each independently comprise a substrate for a protease that is more prevalently found in diseased tissue associated with a cancer. In some embodiments, the cancer is selected from the group of: gastric cancer, breast cancer, osteosarcoma, and esophageal cancer. In some embodiments, the cancer is breast cancer. In some embodiments, the cancer is a HER2-positive cancer. In some embodiments, the cancer is Kaposi sarcoma, hairy cell leukemia, chronic myeloid leukemia (CML), follicular lymphoma, renal cell cancer (RCC), melanoma, neuroblastoma, basal cell carcinoma, cutaneous T-cell lymphoma, nasopharyngeal adenocarcimoa, breast cancer, ovarian cancer, bladder cancer, BCG-resistant non-muscle invasive bladder cancer (NMIBC), endometrial cancer, pancreatic cancer, non-small cell lung cancer (NSCLC), colorectal cancer, esophageal cancer, gallbladder cancer, glioma, head and neck carcinoma, uterine cancer, cervical cancer, or testicular cancer, and the like. In some of the above-described embodiments, the CM components comprise substrates for protease(s) that is/are more prevalent in tumor tissue In some embodiments, CMs each independently include(s) a sequence selected from the group consisting of SEQ ID NO: 5 through SEQ ID NO: 100, as well as C-terminal and N-terminal truncation variants thereof.

In some embodiments, the CM includes a sequence selected from the group of:

```
                        (SEQ ID NO: 28)
    ISSGLLSGRSDNH, (SEQ ID NO: 33)
    LSGRSDDH, (SEQ ID NO: 54)
    ISSGLLSGRSDQH,
    and (SEQ ID NO: 68)
    ISSGLLSGRSDNI.
```

In certain embodiments, CM1 and/or CM1 include(s) a sequence selected from the group of: AQNLLGMY (SEQ ID NO: 264), LSGRSDNHGGAVGLLAPP (SEQ ID NO: 265), VHMPLGFLGPGGLSGRSDNH (SEQ ID NO: 266), LSGRSDNHGGVHMPLGFLGP (SEQ ID NO: 267), LSGRSDNHGGSGGSISSGLLSS (SEQ ID NO: 268), ISSGLLSSGGSGGSLSGRSGNH (SEQ ID NO: 269), LSGRSDNHGGSGGSQNQALRMA (SEQ ID NO: 270), QNQALRMAGGSGGSLSGRSDNH (SEQ ID NO:271), LSGRSGNHGGSGGSQNQALRMA (SEQ ID NO: 272), QNQALRMAGGSGGSLSGRSGNH (SEQ ID NO: 273), ISSGLLSGRSGNH (SEQ ID NO: 274), as well as C-terminal and N-terminal truncation variants thereof. Examples of CMs also include those described in U.S. Patent Application Publication Nos. US20160289324, US20190284283, and in publication numbers WO 2010/081173, WO 2015/048329, WO 2015/116933, WO 2016/118629, and WO 2020/118109, which are incorporated herein by reference in their entireties.

Truncation variants of the aforementioned amino acid sequences that are suitable for use in the CMs are any that retain the recognition site for the corresponding protease. These include C-terminal and/or N-terminal truncation variants comprising at least 3 contiguous amino acids of the above-described amino acid sequences, or at least 4, or at least 5, or at least 6, or at least 7 amino acids of the foregoing amino acid sequences that retain a recognition site for a protease. In certain embodiments, the truncation variant of the above-described amino acid sequences is an amino acid sequence corresponding to any of the above, but that is C- and/or N-terminally truncated by 1 to about 10 amino acids, 1 to about 9 amino acids, 1 to about 8 amino acids, 1 to about 7 amino acids, 1 to about 6 amino acids, 1 to about 5 amino acids, 1 to about 4 amino acids, or 1 to about 3 amino acids, and which: (1) has at least three amino acid residues; and (2) retains a recognition site for a protease. In some of the foregoing embodiments, the truncated CM is an N-terminally truncated CM. In some embodiments, the truncated CM is a C-terminally truncated CM. In some embodiments, the truncated C is a C- and an N-terminally truncated CM.

In some embodiments of any of the activatable cytokine constructs described herein, the CM may comprise a total of about 3 amino acids to about 25 amino acids. In some embodiments, the CM may comprise a total of about 3 amino acids to about 25 amino acids, about 3 amino acids to about 20 amino acids, about 3 amino acids to about 15 amino acids, about 3 amino acids to about 10 amino acids, about 3 amino acids to about 5 amino acids, about 5 amino acids to about 25 amino acids, about 5 amino acids to about 20 amino acids, about 5 amino acids to about 15 amino acids, about 5 amino acids to about 10 amino acids, about 10 amino acids to about 25 amino acids, about 10 amino acids to about 20 amino acids, about 10 amino acids to about 15 amino acids, about 15 amino acids to about 25 amino acids, about 15 amino acids to about 20 amino acids, or about 20 amino acids to about 25 amino acids.

In some embodiments, the ACC may comprise multiple CMs that comprise substrates for different proteases. In some embodiments, the ACC may comprise multiple CMs that are substrates for the same protease. In one example, the CM(s) between each CP and PM may be substrates for the same protease as each other, and the CM(s) between each CP and DD may be substrates for the same protease as each other, but may be substrates for a different protease than the CM(s) between the CP and the PM. In another example, the CM(s) between the CP and the PM and the CM(s) between the CP and the DD may comprise substrates for the same protease. In another example, the CM(s) between the CP and the PM may comprise substrates for different proteases. In another example, the CM(s) between the CP and the PM may comprise substrates for the same protease. In another example, the CM(s) between the CP and the DD may comprise substrates for different proteases. In another example, the CM(s) between the CP and the DD may comprise substrates for the same protease.

The first and second monomer constructs may comprise one or more additional components including one or more linkers, and the like. In some embodiments, the first monomer can include a linker disposed between the CP1 and the CM1. In some embodiments, the CP1 and the CM1 directly abut each other in the first monomer. In some embodiments, the first monomer comprises a linker disposed between the CM1 and the DD1. In some embodiments, the CM1 and the DD1 directly abut each other in the first monomer. In some embodiments, the first monomer can include a linker disposed between the CP1 and the CM3. In some embodiments, the CP1 and the CM3 directly abut each other in the first monomer. In some embodiments, the first monomer can include a linker disposed between the CP1 and the PM1. In some embodiments, the CP1 and the PM1 directly abut each other in the first monomer. In some embodiments, the linker has a total length of 1 amino acid to about 15 amino acids. In some embodiments, the CM and any linkers disposed between the CP1 and DD1 have a combined total length of 3 to 15 amino acids, or 3 to 10 amino acids, or 3 to 7 amino acids.

In some embodiments, the second monomer comprises a linker disposed between the CP2 and the CM2. In some embodiments, the CP2 and the CM2 directly abut each other in the second monomer. In some embodiments, the second monomer comprises a linker disposed between the CM2 and the DD2. In some embodiments, the CM2 (e.g., any of the cleavable moieties described herein) and the DD2 (e.g., any of the DDs described herein) directly abut each other in the second monomer. In some embodiments, the second monomer can include a linker disposed between the CP2 and the CM4. In some embodiments, the CP2 and the CM4 directly abut each other in the second monomer. In some embodiments, the second monomer can include a linker disposed between the CP2 and the PM2. In some embodiments, the CP2 and the PM2 directly abut each other in the second monomer. In some embodiments, the linker has a total length of 1 amino acid to about 15 amino acids. In some embodiments, the linker comprises a sequence of GGGS (SEQ ID NO: 2). In some embodiments, the CM and any linkers disposed between the CP2 and DD2 have a combined total length of 3 to 15 amino acids, or 3 to 10 amino acids, or 3 to 7 amino acids.

In some embodiments, the first monomer and/or the second monomer can include a total of about 50 amino acids to about 800 amino acids, about 50 amino acids to about 750 amino acids, about 50 amino acids to about 700 amino acids, about 50 amino acids to about 650 amino acids, about 50 amino acids to about 600 amino acids, about 50 amino acids to about 550 amino acids, about 50 amino acids to about 500 amino acids, about 50 amino acids to about 450 amino acids, about 50 amino acids to about 400 amino acids, about 50 amino acids to about 350 amino acids, about 50 amino acids to about 300 amino acids, about 50 amino acids to about 250 amino acids, about 50 amino acids to about 200 amino acids, about 50 amino acids to about 150 amino acids, about 50 amino acids to about 100 amino acids, about 100 amino acids to about 800 amino acids, about 100 amino acids to about 750 amino acids, about 100 amino acids to about 700 amino acids, about 100 amino acids to about 650 amino acids, about 100 amino acids to about 600 amino acids, about 100 amino acids to about 550 amino acids, about 100 amino acids to about 500 amino acids, about 100 amino acids to about 450 amino acids, about 100 amino acids to about 400 amino acids, about 100 amino acids to about 350 amino acids, about 100 amino acids to about 300 amino acids, about 100 amino acids to about 250 amino acids, about 100 amino acids to about 200 amino acids, about 100 amino acids to about 150 amino acids, about 150 amino acids to about 800 amino acids, about 150 amino acids to about 750 amino acids, about 150 amino acids to about 700 amino acids, about 150 amino acids to about 650 amino acids, about 150 amino acids to about 600 amino acids, about 150 amino acids to about 550 amino acids, about 150 amino acids to about 500 amino acids, about 150 amino acids to about 450 amino acids, about 150 amino acids to about 400 amino acids, about 150 amino acids to about 350 amino acids, about 150 amino acids to about 300 amino acids, about 150 amino acids to about 250 amino acids, about 150 amino acids to about 200 amino acids, about 200 amino acids to about 800 amino acids, about 200 amino acids to about 750 amino acids, about 200 amino acids to about 700 amino acids, about 200 amino acids to about 650 amino acids, about 200 amino acids to about 600 amino acids, about 200 amino acids to about 550 amino acids, about 200 amino acids to about 500 amino acids, about 200 amino acids to about 450 amino acids, about 200 amino acids to about 400 amino acids, about 200 amino acids to about 350 amino acids, about 200 amino acids to about 300 amino acids, about 200 amino acids to about 250 amino acids, about 250 amino acids to about 800 amino acids, about 250 amino acids to about 750 amino acids, about 250 amino acids to about 700 amino acids, about 250 amino acids to about 650 amino acids, about 250 amino acids to about 600 amino acids, about 250 amino acids to about 550 amino acids, about 250 amino acids to about 500 amino acids, about 250 amino acids to about 450 amino acids, about 250 amino acids to about 400 amino acids, about 250 amino acids to about 350 amino acids, about 250 amino acids to about 300 amino acids, about 300 amino acids to about 800 amino acids, about 300 amino acids to about 750 amino acids, about 300 amino acids to about 700 amino acids, about 300 amino acids to about 650 amino acids, about 300 amino acids to about 600 amino acids, about 300 amino acids to about 550 amino acids, about 300 amino acids to about 500 amino acids, about 300 amino acids to about 450 amino acids, about 300 amino acids to about 400 amino acids, about 300 amino acids to about 350 amino acids, about 350 amino acids to about 800 amino acids, about 350 amino acids to about 750 amino acids, about 350 amino acids to about 700 amino acids, about 350 amino acids to about 650 amino acids, about 350 amino acids to about 600 amino acids, about 350 amino acids to about 550 amino acids, about 350 amino acids to about 500 amino acids, about 350 amino acids to about 450 amino acids, about 350 amino acids to about 400 amino acids, about 400 amino acids to about 800 amino acids, about 400 amino acids to about 750 amino acids, about 400 amino acids to about 700 amino acids, about 400 amino acids to about 650 amino acids, about 400 amino acids to about 600 amino acids, about 400 amino acids to about 550 amino acids, about 400 amino acids to about 500 amino acids, about 400 amino acids to about 450 amino acids, about 450 amino acids to about 800 amino acids, about 450 amino acids to about 750 amino acids, about 450 amino acids to about 700 amino acids, about 450 amino acids to about 650 amino acids, about 450 amino acids to about 600 amino acids, about 450 amino acids to about 550 amino acids, about 450 amino acids to about 500 amino acids, about 500 amino acids to about 800 amino acids, about 500 amino acids to about 750 amino acids, about 500 amino acids to about 700 amino acids, about 500 amino acids to about 650 amino acids, about 500 amino acids to about 600 amino acids, about 500 amino acids to about 550 amino acids, about 550 amino acids to about 800 amino acids, about 550 amino acids to about 750 amino acids, about 550 amino acids to about 700 amino acids, about 550 amino acids to about 650 amino acids, about 550 amino acids to about 600 amino acids, about 600 amino acids to about 800 amino acids, about 600 amino acids to about 750 amino acids, about 600 amino acids to about 700 amino acids, about 600 amino acids to about 650 amino acids, about 650 amino acids to about 800 amino acids, about 650 amino acids to about 750 amino acids, about 650 amino acids to about 700 amino acids, about 700 amino acids to about 800 amino acids, about 700 amino acids to about 750 amino acids, or about 750 amino acids to about 800 amino acids.

Figure 16:
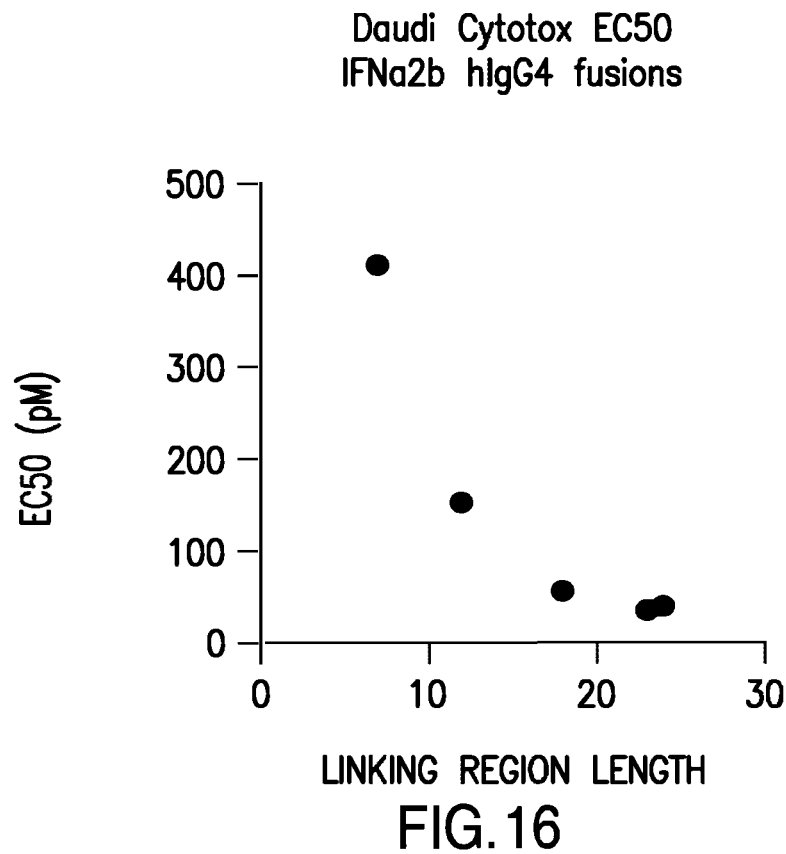
FIG. 16 depicts the effect of length of a Linking Region (LR) on the activities of IFNalpha-2b-Fc fusion proteins without a peptide mask, as determined from a Daudi apoptosis assay.

In some embodiments of any of the ACCs described herein, one or more linkers (e.g., flexible linkers) can be introduced into the activatable cytokine construct to provide flexibility at one or more of the junctions between domains, between moieties, between moieties and domains, or at any other junctions where a linker would be beneficial. In some embodiments, where the ACC is provided as a conformationally constrained construct, a flexible linker can be inserted to facilitate formation and maintenance of a structure in the uncleaved activatable cytokine construct. Any of the linkers described herein can provide the desired flexibility to facilitate the inhibition of the binding of a target (e.g., a receptor of a cytokine), or to facilitate cleavage of a CM by a protease. In some embodiments, linkers are included in the ACC that are all or partially flexible, such that the linker can include a flexible linker as well as one or more portions that confer less flexible structure to provide for a desired ACC. Some linkers may include cysteine residues, which may form disulfide bonds and reduce flexibility of the construct. It has been found that reducing the length of the linkers or linking region reduces the activity of the mature cytokine protein in ACCs (see, e.g., FIG. 16 showing data for ACCs without a peptide affinity mask). In most instances, linker length is determined by counting, in a N- to C-direction, the number of amino acids from the N-terminus of the linker adjacent to the C-terminal amino acid of the preceding component, to the C-terminus of the linker adjacent to the N-terminal amino acid of the following component (i.e., where the linker length does not include either the C-terminal amino acid of the preceding component or the N-terminal amino acid of the following component). In embodiments in which a linker is employed at the N-terminus of a DD that comprises an Fc domain, linker length is determined by counting the number of amino acids from the N-terminus of the linker adjacent to the C-terminal amino acid of the preceding component to C-terminus of the linker adjacent to the first cysteine of an Fc hinge region that participates in the disulfide linkage with a second Fc domain (i.e., where the linker length does not include the C-terminal amino acid of the preceding component or the first cysteine of the Fc hinge region).

Figure 18:
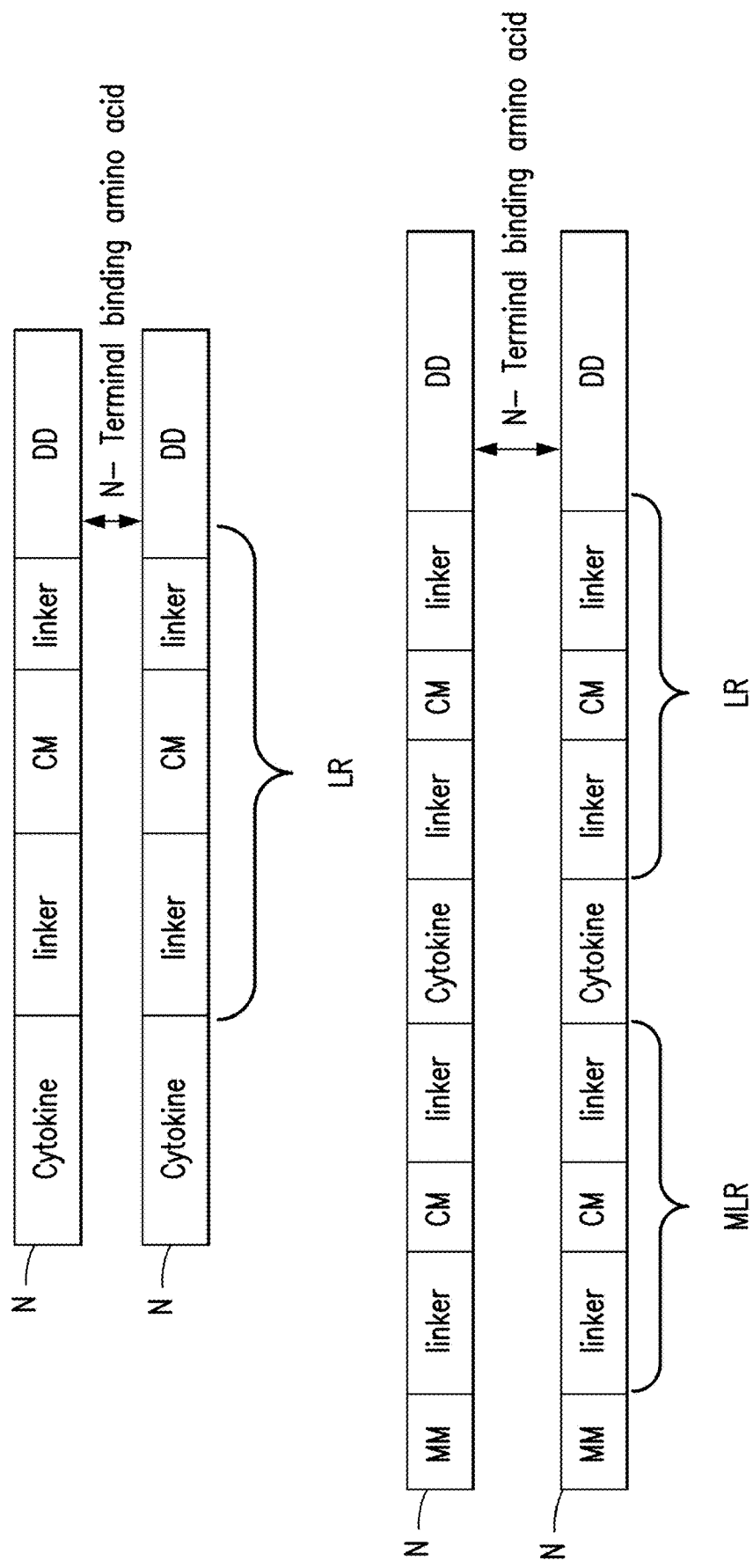
FIG. 18 schematically illustrates a cytokine construct including a depiction of the linking region (LR) and mask linking region (MLR).

As apparent from the present disclosure and FIG. 18, ACCs of the present disclosure include a stretch of amino acids between the CP and the proximal point of interaction between the dimerization domains. That stretch of amino acids may be referred to as a Linking Region (LR) as defined above.

In some embodiments, additional amino acid sequences may be positioned N-terminally or C-terminally to any of the domains of any of the ACCs. Examples include, but are not limited to, targeting moieties (e.g., a ligand for a receptor of a cell present in a target tissue) and serum half-life extending moieties (e.g., polypeptides that bind serum proteins, such as immunoglobulin (e.g., IgG) or serum albumin (e.g., human serum albumin (HSA)).

In some embodiments of any of the activatable cytokine constructs described herein, the linker can include a total of about 1 amino acid to about 25 amino acids (e.g., about 1 amino acid to about 24 amino acids, about 1 amino acid to about 22 amino acids, about 1 amino acid to about 20 amino acids, about 1 amino acid to about 18 amino acids, about 1 amino acid to about 16 amino acids, about 1 amino acid to about 15 amino acids, about 1 amino acid to about 14 amino acids, about 1 amino acid to about 12 amino acids, about 1 amino acid to about 10 amino acids, about 1 amino acid to about 8 amino acids, about 1 amino acid to about 6 amino acids, about 1 amino acid to about 5 amino acids, about 1 amino acid to about 4 amino acids, about 1 amino acid to about 3 amino acids, about 1 amino acid to about 2 amino acids, about 2 amino acids to about 25 amino acids, about 2 amino acids to about 24 amino acids, about 2 amino acids to about 22 amino acids, about 2 amino acids to about 20 amino acids, about 2 amino acids to about 18 amino acids, about 2 amino acids to about 16 amino acids, about 2 amino acids to about 15 amino acids, about 2 amino acids to about 14 amino acids, about 2 amino acids to about 12 amino acids, about 2 amino acids to about 10 amino acids, about 2 amino acids to about 8 amino acids, about 2 amino acids to about 6 amino acids, about 2 amino acids to about 5 amino acids, about 2 amino acids to about 4 amino acids, about 2 amino acids to about 3 amino acids, about 4 amino acids to about 25 amino acids, about 4 amino acids to about 24 amino acids, about 4 amino acids to about 22 amino acids, about 4 amino acids to about 20 amino acids, about 4 amino acids to about 18 amino acids, about 4 amino acids to about 16 amino acids, about 4 amino acids to about 15 amino acids, about 4 amino acids to about 14 amino acids, about 4 amino acids to about 12 amino acids, about 4 amino acids to about 10 amino acids, about 4 amino acids to about 8 amino acids, about 4 amino acids to about 6 amino acids, about 4 amino acids to about 5 amino acids, about 5 amino acids to about 25 amino acids, about 5 amino acids to about 24 amino acids, about 5 amino acids to about 22 amino acids, about 5 amino acids to about 20 amino acids, about 5 amino acids to about 18 amino acids, about 5 amino acids to about 16 amino acids, about 5 amino acids to about 15 amino acids, about 5 amino acids to about 14 amino acids, about 5 amino acids to about 12 amino acids, about 5 amino acids to about 10 amino acids, about 5 amino acids to about 8 amino acids, about 5 amino acids to about 6 amino acids, about 6 amino acids to about 25 amino acids, about 6 amino acids to about 24 amino acids, about 6 amino acids to about 22 amino acids, about 6 amino acids to about 20 amino acids, about 6 amino acids to about 18 amino acids, about 6 amino acids to about 16 amino acids, about 6 amino acids to about 15 amino acids, about 6 amino acids to about 14 amino acids, about 6 amino acids to about 12 amino acids, about 6 amino acids to about 10 amino acids, about 6 amino acids to about 8 amino acids, about 8 amino acids to about 25 amino acids, about 8 amino acids to about 24 amino acids, about 8 amino acids to about 22 amino acids, about 8 amino acids to about 20 amino acids, about 8 amino acids to about 18 amino acids, about 8 amino acids to about 16 amino acids, about 8 amino acids to about 15 amino acids, about 8 amino acids to about 14 amino acids, about 8 amino acids to about 12 amino acids, about 8 amino acids to about 10 amino acids, about 10 amino acids to about 25 amino acids, about 10 amino acids to about 24 amino acids, about 10 amino acids to about 22 amino acids, about 10 amino acids to about 20 amino acids, about 10 amino acids to about 18 amino acids, about 10 amino acids to about 16 amino acids, about 10 amino acids to about 15 amino acids, about 10 amino acids to about 14 amino acids, about 10 amino acids to about 12 amino acids, about 12 amino acids to about 25 amino acids, about 12 amino acids to about 24 amino acids, about 12 amino acids to about 22 amino acids, about 12 amino acids to about 20 amino acids, about 12 amino acids to about 18 amino acids, about 12 amino acids to about 16 amino acids, about 12 amino acids to about 15 amino acids, about 12 amino acids to about 14 amino acids, about 14 amino acids to about 25 amino acids, about 14 amino acids to about 24 amino acids, about 14 amino acids to about 22 amino acids, about 14 amino acids to about 20 amino acids, about 14 amino acids to about 18 amino acids, about 14 amino acids to about 16 amino acids, about 14 amino acids to about 15 amino acids, about 15 amino acids to about 25 amino acids, about 15 amino acids to about 24 amino acids, about 15 amino acids to about 22 amino acids, about 15 amino acids to about 20 amino acids, about 15 amino acids to about 18 amino acids, about 15 amino acids to about 16 amino acids, about 16 amino acids to about 25 amino acids, about 16 amino acids to about 24 amino acids, about 16 amino acids to about 22 amino acids, about 16 amino acids to about 20 amino acids, about 16 amino acids to about 18 amino acids, about 18 amino acids to about 25 amino acids, about 18 amino acids to about 24 amino acids, about 18 amino acids to about 22 amino acids, about 18 amino acids to about 20 amino acids, about 20 amino acids to about 25 amino acids, about 20 amino acids to about 24 amino acids, about 20 amino acids to about 22 amino acids, about 22 amino acid to about 25 amino acids, about 22 amino acid to about 24 amino acids, or about 24 amino acid to about 25 amino acids).

In some embodiments of any of the ACCs described herein, the linker includes a total of about 1 amino acid, about 2 amino acids, about 3 amino acids, about 4 amino acids, about 5 amino acids, about 6 amino acids, about 7 amino acids, about 8 amino acids, about 9 amino acids, about 10 amino acids, about 11 amino acids, about 12 amino acids, about 13 amino acids, about 14 amino acids, about 15 amino acids, about 16 amino acids, about 17 amino acids, about 18 amino acids, about 19 amino acids, about 20 amino acids, about 21 amino acids, about 22 amino acids, about 23 amino acids, about 24 amino acids, or about 25 amino acids.

Surprisingly, the applicant has discovered that ACCs that do not comprise any linkers between the CP and the DD exhibit the most significant reduction in cytokine activity relative to the wildtype mature cytokine, compared to ACCs that include linkers or additional sequences in the linking region. See, e.g., FIG. 16 (showing data for ACCs without a peptide affinity mask). Further, a configuration in which there are no linkers between the CP and the DD still allows effective cleavage of a CM positioned between the CP and the DD. See e.g., FIGS. 7A, 7B, 10A-10C. Thus, in some embodiments, the ACC does not comprise any linkers between the CP and the DD, and the CM between the CP and the DD comprises not more than 10, 9, 8, 7, 6, 5, 4, or 3 amino acids. In some embodiments the total number of amino acids in the LR comprises not more than 25 amino acids, e.g., not more than 25, 24, 23, 22, 21, 20, 19, 18, 17, 16, 15, 14, 13, 12, 11, 10, 9, 8, 7, 6, 5, 4, or 3 amino acids, or 3 to 10 amino acids or 5 to 15 amino acids, or 7 to 12 amino acids, or any range or specific number of amino acids selected from the range encompassed by 3 to 25 amino acids.

In some embodiments of any of the ACCs described herein, a linker can be rich in glycine (Gly or G) residues. In some embodiments, the linker can be rich in serine (Ser or S) residues. In some embodiments, the linker can be rich in glycine and serine residues. In some embodiments, the linker has one or more glycine-serine residue pairs (GS) (e.g., 1, 2, 3, 4, 5, 6, 7, 8, 9, or 10 or more GS pairs). In some embodiments, the linker has one or more Gly-Gly-Gly-Ser (GGGS) (SEQ ID NO: 2) sequences (e.g., 1, 2, 3, 4, 5, 6, 7, 8, 9, or 10 or more GGGS sequences). In some embodiments, the linker has one or more Gly-Gly-Gly-Gly-Ser (GGGGS) (SEQ ID NO: 216) sequences (e.g., 1, 2, 3, 4, 5, 6, 7, 8, 9, or 10 or more GGGGS sequences). In some embodiments, the linker has one or more Gly-Gly-Ser-Gly (GGSG) (SEQ ID NO: 229) sequences (e.g., 1, 2, 3, 4, 5, 6, 7, 8, 9, or 10 or more GGSG sequences).

In some embodiments of any of the ACCs described herein, a linker includes any one of or a combination of one or more of: GSSGGSGGSGG (SEQ ID NO: 210), GGGS (SEQ ID NO: 2), GGGSGGGS (SEQ ID NO: 211), GGGSGGGSGGGS (SEQ ID NO: 212), GGGGSGGGGSGGGGS (SEQ ID NO: 213), GGGGSGGGGSGGGGSGGGGSGGGGS (SEQ ID NO: 214), GGGGSGGGGS (SEQ ID NO: 215), GGGGS (SEQ ID NO: 216), GS, GGGGSGS (SEQ ID NO: 217), GGGGSGGGGSGGGGSGS (SEQ ID NO: 218), GGSLDPKGGGGS (SEQ ID NO: 219), PKSCDKTH-TCPPCPAPELLG (SEQ ID NO: 220), SKYGPPCPPCPA-PEFLG (SEQ ID NO: 221), GKSSGSGSESKS (SEQ ID NO: 222), GSTSGSGKSSEGKG (SEQ ID NO: 223), GST-SGSGKSSEGSGSTKG (SEQ ID NO: 224), and GST-SGSGKPGSGEGSTKG (SEQ ID NO: 225).

Non-limiting examples of linkers can include a sequence that is at least 70% identical (e.g., at least 72%, at least 74%, at least 75%, at least 76%, at least 78%, at least 80%, at least 82%, at least 84%, at least 85%, at least 86%, at least 88%, at least 90%, at least 92%, at least 94%, at least 95%, at least 96%, at least 97%, at least 98%, at least 99%, or 100% identical) to GGGS (SEQ ID NO: 2), GSSGGSGGSGG (SEQ ID NO: 210), GGGGSGGGGSGGGGS (SEQ ID NO: 213), GGGGSGS (SEQ ID NO: 217), GGGGSGGGGSGGGGSGS (SEQ ID NO: 218), GGGGSGGGGSGGGGSGGGGS (SEQ ID NO: 214), GGSLDPKGGGGS (SEQ ID NO: 215), and GST-SGSGKPGSSEGST (SEQ ID NO: 226).

In some embodiments, the linker includes a sequence selected from the group of: GGSLDPKGGGGS (SEQ ID NO: 219), GGGGSGGGGSGGGGSGS (SEQ ID NO: 218), GGGGSGS (SEQ ID NO: 217), GS, (GS)n, (GGS)n, (GSGGS)n (SEQ ID NO: 227) and (GGGS)n (SEQ ID NO: 228), GGSG (SEQ ID NO: 229), GGSGG (SEQ ID NO: 230), GSGSG (SEQ ID NO: 231), GSGGG (SEQ ID NO: 232), GGGSG (SEQ ID NO: 233), GSSSG (SEQ ID NO: 234), GGGGSGGGGSGGGGS (SEQ ID NO: 213), GGGGSGGGGSGGGGSGGGGS (SEQ ID NO: 214), GST-SGSGKPGSSEGST (SEQ ID NO: 226), (GGGGS)n (SEQ ID NO: 216), wherein n is an integer of at least one. In some embodiments, the linker includes a sequence selected from the group consisting of: GGSLDPKGGGGS (SEQ ID NO: 219), GGGGSGGGGSGGGGSGS (SEQ ID NO: 218), GGGGSGS (SEQ ID NO: 217), and GS. In some embodiments of any of the ACCs described herein, the linker includes a sequence selected from the group of: GGGGSGGGGSGGGGS (SEQ ID NO: 213), GGGGSGGGGSGGGGSGGGGS (SEQ ID NO: 214), and GSTSGSGKPGSSEGST (SEQ ID NO: 226). In some embodiments of any of the activatable cytokine constructs described herein, the linker includes a sequence selected from the group of: GGGGSGGGGSGGGGS (SEQ ID NO: 213) or GGGGS (SEQ ID NO: 216). In some embodiments, the linker comprises a sequence of GGGS (SEQ ID NO: 2). Additional examples of linkers include those listed in Table 11.

In some embodiments, an ACC can include one, two, three, four, five, six, seven, eight, nine, or ten linker sequence(s) (e.g., the same or different linker sequences of any of the exemplary linker sequences described herein or known in the art). In some embodiments, a linker comprises sulfo-SIAB, SMPB, and sulfo-SMPB, wherein the linkers react with primary amines sulfhydryls.

In some embodiments of any of the ACCs described herein, the ACC is characterized by a reduction in at least one activity of the CP1 and/or CP2 as compared to a control level of the at least one activity of the CP1 and/or CP2. In some embodiments, a control level can be the level of the activity for a recombinant CP1 and/or CP2 (e.g., a commercially available recombinant CP1 and/or CP2, a recombinant wildtype CP1 and/or CP2, and the like). In some embodiments, a control level can be the level of the activity of a cleaved (activated) form of the ACC. In certain embodiments, a control level can be the level of the activity of a pegylated CP1 and/or CP2.

In some embodiments, the at least one activity is the binding affinity of the CP1 and/or the CP2 for its cognate receptor as determined using surface plasmon resonance (e.g., performed in phosphate buffered saline at 25 degrees Celsius). In certain embodiments, the at least one activity is the level of proliferation of lymphoma cells. In other embodiments, the at least one activity is the level of JAK/STAT/ISGF3 pathway activation in a lymphoma cell. In some embodiments, the at least one activity is a level of SEAP production in a lymphoma cell. In a further embodiment, the at least one activity of the CP1 and/or CP2 is level of cytokine-stimulated gene induction using, for example RNAseq methods (see, e.g., Zimmerer et al., *Clin. Cancer Res.* 14(18):5900-5906, 2008; Hilkens et al., *J. Immunol.* 171:5255-5263, 2003).

In some embodiments, the ACC is characterized by at least a 2-fold reduction in at least one CP1 and/or CP2 activity as compared to the control level of the at least one CP1 and/or CP2 activity. In some embodiments, the ACC is characterized by at least a 5-fold reduction in at least one activity of the CP1 and/or CP2 as compared to the control level of the at least one activity of the CP1 and/or CP2. In some embodiments, the ACC is characterized by at least a 10-fold reduction in at least one activity of the CP1 and/or CP2 as compared to the control level of the at least one activity of the CP1 and/or CP2. In some embodiments, the ACC is characterized by at least a 20-fold reduction in at least one activity of the CP1 and/or CP2 as compared to the control level of the at least one activity of the CP1 and/or CP2. In some embodiments, the ACC is characterized by at least a 30-fold, 40-fold, 50-fold, 60-fold, 70-fold, 80-fold, 90-fold, 100-fold, 500-fold, 1000-fold, 2000-fold, 3000-fold, 5000-fold or 5,000-fold reduction in at least one activity of the CP1 and/or CP2 as compared to the control level of the at least one activity of the CP1 and/or CP2. In some embodiments, ACC is characterized by at least a 1- to 20-fold reduction, a 200- to 2000-fold reduction, a 300- to 2000-fold reduction, a 400- to 2000-fold reduction, a 500- to 2000-fold reduction, a 1000- to 2000-fold reduction, a 1500- to 2000-fold reduction, a 100- to 1500-fold reduction, a 200- to 1500-fold reduction, a 300- to 1500-fold reduction, a 400- to 1500-fold reduction, a 500- to 1500-fold reduction, a 1000- to 1500-fold reduction, a 100- to 1000-fold reduction, a 200- to 1000-fold reduction, a 300- to 1000-fold reduction, a 400- to 1000-fold reduction, a 500- to 1000-fold reduction, a 1000- to 5000-fold reduction, a 2000- to 5000-fold reduction, a 3000- to 5000-fold reduction, a 4000- to 5000-fold reduction, a 1000- to 4000-fold reduction, a 2000- to 4000-fold reduction, a 3000- to 4000-fold reduction, a 1000- to 3000-fold reduction, a 2000- to 3000-fold reduction, or a 1000- to 2000-fold reduction in at least one activity of the CP1 and/or CP2 as compared to the control level of the at least one activity of the CP1 and/or CP2.

In some embodiments, the control level of the at least one activity of the CP1 and/or CP2 is the activity of the CP1 and/or CP2 released from the ACC following cleavage of the CMs by protease(s) (the "cleavage product"). In some embodiments, the control level of the at least one activity of the CP1 and/or CP2 is the activity of a corresponding wildtype mature cytokine (e.g., recombinant wildtype mature cytokine).

In some embodiments, incubation of the ACC with the protease yields an activated cytokine product(s), where one or more activities of CP1 and/or CP2 of the activated cytokine product(s) is greater than the one or more activities of CP1 and/or CP2 of the intact ACC. In some embodiments, one or more activities of CP1 and/or CP2 of the activated cytokine product(s) is at least 1-fold greater than the one or more activities of CP1 and/or CP2 of the ACC. In some embodiments, one or more activities of CP1 and/or CP2 of the activated cytokine product(s) is at least 2-fold greater than the one or more activities of CP1 and/or CP2 of the ACC. In some embodiments, one or more activities of CP1 and/or CP2 of the activated cytokine product(s) is at least 5-fold greater than the one or more activities of CP1 and/or CP2 of the ACC. In some embodiments, one or more activities of CP1 and/or CP2 of the activated cytokine product(s) is at least 10-fold greater than the one or more activities of CP1 and/or CP2 of the ACC. In some embodiments, one or more activities of CP1 and/or CP2 of the activated cytokine product(s) is at least 20-fold greater than the one or more activities of CP1 and/or CP2 of the ACC. In some embodiments, one or more activities of CP1 and/or CP2 of the activated cytokine product(s) is at least 1- to 20-fold greater, a 200- to 2000-fold greater, a 300- to 2000-fold greater, a 400- to 2000-fold greater, a 500- to 2000-fold greater, a 1000- to 2000-fold greater, a 1500- to 2000-fold greater, a 100- to 1500-fold greater, a 200- to 1500-fold greater, a 300- to 1500-fold greater, a 400- to 1500-fold greater, a 500- to 1500-fold greater, a 1000- to 1500-fold greater, a 100- to 1000-fold greater, a 200- to 1000-fold greater, a 300- to 1000-fold greater, a 400- to 1000-fold greater, a 500- to 1000-fold greater, a 1000- to 5000-fold greater, a 2000- to 5000-fold greater, a 3000- to 5000-fold greater, a 4000- to 5000-fold greater, a 1000- to 4000-fold greater, a 2000- to 4000-fold greater, a 3000- to 4000-fold greater, a 1000- to 3000-fold greater, a 2000- to 3000-fold greater, or a 1000- to 2000-fold than the one or more activities of CP1 and/or CP2 of the ACC.

In some embodiments, an ACC can include a sequence that is at least 80% (e.g., at least 82%, at least 84%, at least 86%, at least 88%, at least 90%, at least 92%, at least 94%, at least 96%, at least 98%, at least 99%, or 100%) identical to SEQ ID NO: 321 or 322. In some embodiments, an ACC can be encoded by a nucleic acid including a sequence that is at least 80% (e.g., at least 82%, at least 84%, at least 86%, at least 88%, at least 90%, at least 92%, at least 94%, at least 96%, at least 98%, at least 99%, or 100%) identical to a nucleic acid encoding SEQ ID NOs: 321 or 322. In some aspects, an ACC may include such sequences but either without the signal sequences of those sequences. Signal sequences are not particularly limited. Some non-limiting examples of signal sequences include, e.g., SEQ ID NO: 244 and corresponding residues and nucleotides in the other sequences, or substituted with a signal sequence from another species or cell line. Other examples of signal sequences include

```
                                          (SEQ ID NO: 242)
MRAWIFFLLCLAGRALA
and
                                          (SEQ ID NO: 243)
MALTFALLVALLVLSCKSSCSVG.
```

Various exemplary aspects of these activatable cytokine constructs are described below and can be used in any combination in the methods provided herein without limitation. Exemplary aspects of the activatable cytokine constructs and methods of making activatable cytokine constructs are described below.

In some embodiments, the CM is selected for use with a specific protease. The protease may be one produced by a tumor cell (e.g., the tumor cell may express greater amounts of the protease than healthy tissues). In some embodiments, the CM is a substrate for at least one protease selected from the group of an ADAM 17, a BMP-1, a cysteine protease such as a cathepsin, a HtrA1, a legumain, a matriptase (MT-SP1), a matrix metalloprotease (MMP), a neutrophil elastase, a TMPRSS, such as TMPRSS3 or TMPRSS4, a thrombin, and a u-type plasminogen activator (uPA, also referred to as urokinase).

In some embodiments, a CM is a substrate for at least one matrix metalloprotease (MMP). Examples of MMPs include MMP1, MMP2, MMP3, MMP7, MMP8, MMP9, MMP10, MMP11, MMP12, MMP13, MMP14, MMP15, MMP16, MMP17, MMP19, MMP20, MMP23, MMP24, MMP26, and MMP27. In some embodiments, the CM is a substrate for MMP9, MMP14, MMP1, MMP3, MMP13, MMP17, MMP11, and MMP19. In some embodiments, the CM is a substrate for MMP7. In some embodiments, the CM is a substrate for MMP9. In some embodiments, the CM is a substrate for MMP14. In some embodiments, the CM is a substrate for two or more MMPs. In some embodiments, the CM is a substrate for at least MMP9 and MMP14. In some embodiments, the CM includes two or more substrates for the same MMP. In some embodiments, the CM includes at least two or more MMP9 substrates. In some embodiments, the CM includes at least two or more MMP14 substrates.

In some embodiments, a CM is a substrate for an MMP and includes the sequence

```
                                          (SEQ ID NO: 19)
ISSGLLSS;

(SEQ ID NO: 16)
QNQALRMA;

(SEQ ID NO: 15)
AQNLLGMV;
```

-continued

STFPFGMF; (SEQ ID NO: 18)

PVGYTSSL; (SEQ ID NO: 74)

DWLYWPGI; (SEQ ID NO: 75)

MIAPVAYR; (SEQ ID NO: 42)

RPSPMWAY; (SEQ ID NO: 43)

WATPRPMR; (SEQ ID NO: 44)

FRLLDWQW; (SEQ ID NO: 45)

LKAAPRWA; (SEQ ID NO: 76)

GPSHLVLT; (SEQ ID NO: 77)

LPGGLSPW; (SEQ ID NO: 78)

MGLFSEAG; (SEQ ID NO: 79)

SPLPLRVP; (SEQ ID NO: 80)

RMIALRSLG; (SEQ ID NO: 81)

LAAPLGLL; (SEQ ID NO: 17)

AVGLLAPP; (SEQ ID NO: 14)

LLAPSHRA; (SEQ ID NO: 82)

PAGLWLDP; (SEQ ID NO: 20)
and/or

ISSGLSS. (SEQ ID NO: 73)

In some embodiments, a CM is a substrate for thrombin. In some embodiments, the CM is a substrate for thrombin and includes the sequence GPRSFGL (SEQ ID NO: 83) or GPRSFG (SEQ ID NO: 84).

In some embodiments, a CM includes an amino acid sequence selected from the group of NTLSGRSENHSG (SEQ ID NO: 9); NTLSGRSGNHGS (SEQ ID NO: 10); TSTSGRSANPRG (SEQ ID NO: 11); TSGRSANP (SEQ ID NO: 12); VAGRSMRP (SEQ ID NO: 21); VVPEGRRS (SEQ ID NO: 22); ILPRSPAF (SEQ ID NO: 23); MVLGRSLL (SEQ ID NO: 24); QGRAITFI (SEQ ID NO: 25); SPRSIMLA (SEQ ID NO: 26); and SMLRSMPL (SEQ ID NO: 27).

In some embodiments, a CM is a substrate for a neutrophil elastase. In some embodiments, a CM is a substrate for a serine protease. In some embodiments, a CM is a substrate for uPA. In some embodiments, a CM is a substrate for legumain. In some embodiments, the CM is a substrate for matriptase. In some embodiments, the CM is a substrate for a cysteine protease. In some embodiments, the CM is a substrate for a cysteine protease, such as a cathepsin.

In some embodiments, a CM includes a sequence of ISSGLLSGRSDNH (SEQ ID NO: 28); ISSGLLSSGGSGGSLSGRSDNH (SEQ ID NO: 30); AVGLLAPPGGTSTSGRSANPRG (SEQ ID NO: 275); TSTSGRSANPRGGGAVGLLAPP (SEQ ID NO: 276); VHMPLGFLGPGGTSTSGRSANPRG (SEQ ID NO: 277); TSTSGRSANPRGGGVFIMPLGFLGP (SEQ ID NO: 278); AVGLLAPPGGLSGRSDNH (SEQ ID NO: 29); LSGRSDNHGGAVGLLAPP (SEQ ID NO: 70); VHMPLGFLGPGGLSGRSDNH (SEQ ID NO: 266); LSGRSDNHGGVHMPLGFLGP (SEQ ID NO: 267); LSGRSDNHGGSGGSISSGLLSS (SEQ ID NO: 268); LSGRSGNHGGSGGSISSGLLSS (SEQ ID NO: 279); ISSGLLSSGGSGGSLSGRSGNH (SEQ ID NO: 269); LSGRSDNHGGSGGSQNQALRMA (SEQ ID NO: 270); QNQALRMAGGSGGSLSGRSDNH (SEQ ID NO: 271); LSGRSGNHGGSGGSQNQALRMA (SEQ ID NO: 272); QNQALRMAGGSGGSLSGRSGNH (SEQ ID NO: 273), and/or ISSGLLSGRSGNH (SEQ ID NO: 274).

In some embodiments, a CM comprises a sequence selected from the group consisting of SEQ ID NO: 5 through SEQ ID NO: 100. In some embodiments, the CM comprises a sequence selected from the group of: ISSGLLSGRSDNH (SEQ ID NO: 28), LSGRSDDH (SEQ ID NO: 33), ISSGLLSGRSDQH (SEQ ID NO: 54), SGRSDNI (SEQ ID NO: 100), and ISSGLLSGRSDNI (SEQ ID NO: 68).

In some aspects, the ACC includes a first monomer comprising a CP1 selected from the group consisting of SEQ ID Nos: 1 and 101-209, a CM1 selected from the group consisting of SEQ ID Nos: 5-100 and 264-308, a PM1 selected from the group consisting of SEQ ID Nos: 328-329, 323, and 331-479, a CM3 selected from the group consisting of SEQ ID Nos: 5-100 and 264-308, and a DD1 dimerized with a second monomer comprising a CP2 selected from the group consisting of SEQ ID Nos: 1 and 101-209, a CM2 selected from the group consisting of SEQ ID Nos: 5-100 and 264-308, a PM2 selected from SEQ ID Nos: 328-329, 323, and 331-479, a CM3 selected from the group consisting of SEQ ID Nos: 5-100 and 264-308 and a DD2. In some aspects, the ACC may include, between CP1 and CM1, between CP1 and PM1, between CP1 and CM3, between PM1 and CM3, and/or between CM1 and DD1, a linker selected from the group consisting of SEQ ID Nos: 2 and 210-263, and between CP2 and CM2, between CP2 and PM2, between CP2 and CM4, between PM2 and CM4, and/or between CM2 and DD2, a linker selected from the group consisting of SEQ ID Nos: 2 and 210-263. In some aspects, the PM1 is selected for use with the CP1 in accordance with Table 10, and the PM2 is selected for use with the CP2, in accordance with Table 10.

In some embodiments, the ACC includes a DD1 and/or a DD2 that has an amino acid sequence that is at least 80% identical (e.g., at least 82%, at least 84%, at least 85%, at least 86%, at least 88%, at least 90%, at least 92%, at least 94%, at least 95%, at least 96%, at least 97%, at least 98%, at least 99%, or 100% identical) to SEQ ID NO: 3 or SEQ ID NO: 4. In some embodiments, the ACC includes a DD1 that has an amino acid sequence that is at least 80% identical (e.g., at least 82%, at least 84%, at least 85%, at least 86%, at least 88%, at least 90%, at least 92%, at least 94%, at least 95%, at least 96%, at least 97%, at least 98%, at least 99%, or 100% identical) to SEQ ID NO: 318 or SEQ ID NO: 319. In some embodiments, the ACC includes a DD2 that has an amino acid sequence that is at least 80% identical (e.g., at least 82%, at least 84%, at least 85%, at least 86%, at least 88%, at least 90%, at least 92%, at least 94%, at least 95%, at least 96%, at least 97%, at least 98%, at least 99%, or 100% identical) to SEQ ID NO: 318 or SEQ ID NO: 319.

One or both monomers of the ACC herein may comprise one or more peptide masks (PMs), which can interfere with the binding of the CP to its binding partner (e.g., receptors). In some embodiments, when an ACC is not activated, the PM in the ACC prevents the CP from target binding; but when the ACC is activated, the PM does not substantially or significantly interfere with the CP's binding to its binding partner. In some embodiments, a PM is coupled to a CP by a CM and optionally one or more linkers described herein.

In some embodiments, a PM may interact with the CP, thus reducing or inhibiting the interaction between the CP and its binding partner. In some embodiments, the PM may not specifically bind to the CP, but rather interfere with CP's binding to its binding partner through non-specific interactions such as steric hindrance. For example, the PM may be positioned in the uncleaved ACC such that the tertiary or quaternary structure of the ACC allows the PM to mask the CP through charge-based interaction, thereby holding the PM in place to interfere with binding partner access to the CP.

The structural properties of the PM may be selected according to factors such as the minimum amino acid sequence required for interference with protein binding to target, the target protein-protein binding pair of interest, the size of the cytokine, the presence or absence of linkers, and the like.

The PMs may be identified and/or further optimized through a screening procedure from a library of candidate ACC having variable PMs. For example, a CP and a CM can be selected to provide for a desired enzyme/target combination, and the amino acid sequence of the PM can be identified by the screening procedure described below to identify a PM that provides for a switchable phenotype. For example, a random peptide library (e.g., of peptides comprising about 2 to about 40 amino acids or more) may be used in the screening methods disclosed herein to identify a suitable PM. In specific embodiments, PMs with specific binding affinity for a CP can be identified through a screening procedure that includes providing a library of peptide scaffolds consisting of candidate PMs wherein each scaffold is made up of a transmembrane protein and the candidate PM. The library may then be contacted with an entire or portion of a protein such as a full length protein, a naturally occurring protein fragment, or a non-naturally occurring fragment containing a protein (also capable of binding the binding partner of interest), and identifying one or more candidate PMs having detectably bound protein. The screening may be performed by one more rounds of magnetic-activated sorting (MACS) or fluorescence-activated sorting (FACS), as well as determination of the binding affinity of PM towards the CP and subsequent determination of the masking efficiency, e.g., as described in US20200308243A1, which is incorporated herein by reference in its entirety.

In some embodiments, the PM is unique for the coupled CP. Examples of PMs include PMs that were specifically screened to bind a binding domain of the cytokine or protein fragment (e.g., affinity peptide masks). Methods for screening PMs to obtain PMs unique for the cytokine and those that specifically and/or selectively bind a binding domain of a binding partner/target are provided herein and can include protein display methods. Table 10 discloses exemplary PMs suitable for use with various exemplary CPs.

In some embodiments, when a CP is coupled to a PM and in the presence of a natural binding partner of the CP, there is no binding or substantially no binding of the CP to the binding partner, or no more than 0.001%, 0.01%, 0.1%, 1%, 2%, 3%, 4%, 5%, 6%, 7%, 8%, 9%, 10%, 15%, 20%, 25%, 30%, 35%, 40%, or 50% binding of the CP to its binding partner, as compared to the binding of the CP not coupled to a PM, for at least 2, 4, 6, 8, 12, 28, 24, 30, 36, 48, 60, 72, 84, 96 hours, or 5, 10, 15, 30, 45, 60, 90, 120, 150, 180 days, or 1, 2, 3, 4, 5, 6, 7, 8, 9, 10, 11, 12 months or greater when measured in a masking efficiency assay, e.g., as described in Example 1.

The PMs contemplated by this disclosure may range from 1-50 amino acids (e.g., at least 3, 4, 5, 6, 7, 8, 9, 10, 12, 15, 20, 30, or 40 amino acids, or no greater than 40, 30, 20, 15, 12, 10, 9, 8, 7, 6, 5, 4, or 3 amino acids). In some examples, the PMs may be from 8 to 15 amino acids in length.

The PMs may contain genetically encoded or genetically non-encoded amino acids. Examples of genetically non-encoded amino acids are but not limited to D-amino acids, β-amino acids, and γ-amino acids. In specific embodiments, the PMs contain no more than 50%, 40%, 30%, 20%, 15%, 10%, 5% or 1% of genetically non-encoded amino acids.

The binding affinity of the cytokine towards the target or binding partner when coupled to a PM may be at least 5, 10, 25, 50, 100, 250, 500, 1,000, 2,500, 5,000, 10,000, 50,000, 100,000, 500,000, 1,000,000, 5,000,000, 10,000,000, 50,000,000 or greater times lower than the binding affinity of the cytokine towards its binding partner when not coupled to a PM, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times lower than the binding affinity of the cytokine towards its binding partner when not coupled to a PM.

When the cytokine is coupled to a PM and is in the presence of the binding partner, specific binding of the cytokine to its binding partner may be reduced or inhibited, as compared to the specific binding of the cytokine not coupled to a PM to its binding partner. When compared to the binding of the cytokine not coupled to a PM to its binding partner, the cytokine's ability to bind the binding partner when coupled to a PM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, 96, hours, or 5, 10, 15, 30, 45, 60, 90, 120, 150, 180 days, or 1, 2, 3, 4, 5, 6, 7, 8, 9, 10, 11, 12 months or greater when measured in vivo or in a masking efficiency assay, e.g., as shown in Example 1, an in vitro immunoabsorbant assay, e.g., as described in US20200308243A1.

The $K_D$ of the PM towards the cytokine may be generally greater than the $K_D$ of the cytokine towards the cytokine's binding partner. The $K_D$ of the PM towards the cytokine may be at least 5, 10, 25, 50, 100, 250, 500, 1,000, 2,500, 5,000, 10,000, 100,000, 1,000,000 or even 10,000,000 times greater than the $K_D$ of the cytokine towards its binding partner. Alternatively, the binding affinity of the PM towards the cytokine may be generally lower than the binding affinity of the cytokine towards the cytokine's binding partner. The binding affinity of PM towards the cytokine may be at least 5, 10, 25, 50, 100, 250, 500, 1,000, 2,500, 5,000, 10,000, 100,000, 1,000,000 or 10,000,000 times lower than the binding affinity of the cytokine towards its binding partner.

In some embodiments, the PM comprises at least partial or complete amino acid sequence of a naturally occurring binding partner of the CP (e.g., a receptor of the CP). The PM may be a fragment of a naturally occurring binding partner. The fragment may retain no more than 95%, 90%, 80%, 75%, 70%, 60%, 50%, 40%, 30%, 25%, or 20% nucleic acid or amino acid sequence homology to the naturally occurring binding partner.

In some embodiments, the PM comprises an amino acid sequence that is not naturally occurring or does not contain the amino acid sequence of a naturally occurring binding partner or target protein. In certain embodiments the PM is not a natural binding partner of the CP. The PM may be a modified binding partner for the CP which contains amino acid changes that at least slightly decrease affinity and/or avidity of binding to the CP. In some embodiments the PM contains no or substantially no nucleic acid or amino acid homology to the CP's natural binding partner. In other embodiments the PM is no more than 5%, 10%, 15%, 20%, 25%, 30%, 35%, 40%, 45%, 50%, 55%, 60%, 65%, 70%, 75%, or 80% similar to the natural binding partner of the CP.

In some embodiments, the PM comprises an amino acid sequence that is at least 80% identical (e.g., at least 82%, at least 84%, at least 86%, at least 88%, at least 90%, at least 92%, at least 94%, at least 95%, at least 96%, at least 97%, at least 98%, at least 99%, or 100% identical) to a sequence selected from SEQ ID Nos: 328-329, 323, and 331-479. An exemplary PM for use with a CP that is an interferon, preferably an IFN-alpha, can contain the consensus sequence: TDVDYYREWXXXXXXXX (SEQ ID No: 361), where X is any amino acid.

In some embodiments, an ACC may comprise a pair of PM1 and CP1 or a pair of PM2 and CP2 listed in Table 10, which contains example PMs for use with specific exemplary cytokines. In some examples, the PM1 comprises a sequence selected from the group consisting of SEQ ID NOs: 328, 329, 323, and 331-369, and the CP1 is an interferon; the PM1 comprises a sequence selected from the group consisting of SEQ ID NOs: 328, 329, 323, and 331-364, and the CP1 is an interferon alpha; the PM1 comprises a sequence selected from the group consisting of SEQ ID NOs: 331-360, 362-364, and the CP1 is an interferon beta; the PM1 comprises a sequence selected from the group consisting of SEQ ID NOs: 331-360, 366-369, and the CP1 is an interferon gamma; the PM1 comprises a sequence selected from the group consisting of SEQ ID NOs: 370-374, and the CP1 is an IL-12; the PM1 comprises a sequence selected from the group consisting of SEQ ID NOs: 375-382, 469-477, 478, and the CP1 is an IL-15; the PM1 comprises a sequence selected from the group consisting of SEQ ID NOs: 383-468, 469-478, and the CP1 is an IL-2; or the PM1 comprises a sequence selected from the group consisting of SEQ ID NOs: 478 and 479, and the CP1 is an IL-21. In some examples, the PM2 comprises a sequence selected from the group consisting of SEQ ID NOs: 328, 329, 323, and 331-369, and the CP2 is an interferon; the PM2 comprises a sequence selected from the group consisting of SEQ ID NOs: 328, 329, 323, and 331-364, and the CP2 is an interferon alpha; the PM2 comprises a sequence selected from the group consisting of SEQ ID NOs: 331-360, 362-364, and the CP2 is an interferon beta; the PM2 comprises a sequence selected from the group consisting of SEQ ID NOs: 331-360, 366-369, and the CP2 is an interferon gamma; the PM2 comprises a sequence selected from the group consisting of SEQ ID NOs: 370-374, and the CP2 is an IL-12; the PM2 comprises a sequence selected from the group consisting of SEQ ID NOs: 375-382, 469-477, 478, and the CP2 is an IL-15; the PM2 comprises a sequence selected from the group consisting of SEQ ID NOs: 383-468, 469-478, and the CP2 is an IL-2; or the PM2 comprises a sequence selected from the group consisting of SEQ ID NOs: 478 and 479, and the CP2 is an IL-21.

In some embodiments, the PM may comprise an inactive cytokine. For example, the inactive cytokine may interact with the CP component in the ACC and interfere the interaction between the CP and its binding partner. In one example, the inactive cytokine may comprise a mutation, e.g., an IFN alpha-2b with L130P mutation (SEQ ID No: 329). In another example, the inactive cytokine may be a truncation of a wild type cytokine, e.g., IFN alpha-2b with amino acids 1-150 (SEQ ID No: 328).

In some embodiments, once uncoupled from the cytokine and in a free state, the PM may have a biological activity or a therapeutic effect, such as binding capability. For example, the free peptide can bind with the same or a different binding partner. In certain embodiments the free PM (uncoupled PM) can exert a therapeutic effect, providing a secondary function to the compositions disclosed herein. In some embodiments, once uncoupled from the cytokine and in a free state, the PM may advantageously not exhibit biological activity. For example, in some embodiments the PM in a free state does not elicit an immune response in the subject.

Conjugation to Agents

This disclosure also provides methods and materials for including additional elements in any of the ACCs described herein including, for example, a targeting moiety to facilitate delivery to a cell or tissue of interest, an agent (e.g., a therapeutic agent, an antineoplastic agent), a toxin, or a fragment thereof.

In some embodiments of any of the ACCs described herein, the ACC can be conjugated to a cytotoxic agent, including, without limitation, a toxin (e.g., an enzymatically active toxin of bacterial, fungal, plant, or animal origin, or fragments thereof) or a radioactive isotope. In some embodiments of any of the ACCs described herein, the activatable cytokine construct can be conjugated to a cytotoxic agent including, without limitation, a toxin (e.g., an enzymatically active toxin of bacterial, fungal, plant, or animal origin, or fragments thereof), or a radioactive isotope.

Non-limiting exemplary cytotoxic agents that can be conjugated to any of the ACCs described herein include: dolastatins and derivatives thereof (e.g., auristatin E, AFP, monomethyl auristatin D (MMAD), monomethyl auristatin F (MMAF), monomethyl auristatin E (MMAE), desmethyl auristatin E (DMAE), auristatin F, desmethyl auristatin F (DMAF), dolastatin 16 (DmJ), dolastatin 16 (Dpv), auristatin derivatives (e.g., auristatin tyramine, auristatin quinolone), maytansinoids (e.g., DM-1, DM-4), maytansinoid derivatives, duocarmycin, alpha-amanitin, turbostatin, phenstatin, hydroxyphenstatin, spongistatin 5, spongistatin 7, halistatin 1, halistatin 2, halistatin 3, halocomstatin, pyrrolobenzimidazoles (PBI), cibrostatin6, doxaliform, cemadotin analogue (CemCH2-SH), *Pseudomonas* toxin A (PES8) variant, Pseudomonase toxin A (ZZ-PE38) variant, ZJ-101, anthracycline, doxorubicin, daunorubicin, bryostatin, camptothecin, 7-substituted campothecin, 10, 11-difluoromethylenedioxycamptothecin, combretastatins, debromoaplysiatoxin, KahaMide-F, discodermolide, and Ecteinascidins.

Non-limiting exemplary enzymatically active toxins that can be conjugated to any of the ACCs described herein include: diphtheria toxin, exotoxin A chain from *Pseudomonas aeruginosa*, ricin A chain, abrin A chain, modeccin A chain, alpha-sarcin, *Aleuriies fordii* proteins, dianfhin proteins, *Phytoiaca americana* proteins (e.g., PAPI, PAPII, and PAP-8), *Momordica charantia* inhibitor, curcin, crotirs, *Sapaonaria officinalis* inhibitor, geionin, mitogeliin, restrictocin, phenomycin, neomycin, and tricothecenes.

Non-limiting exemplary anti-neoplastics that can be conjugated to any of the ACCs described herein include: adriamycin, cerubidine, bleomycin, alkeran, velban, oncovin, fluorouracil, methotrexate, thiotepa, bisantrene, novantrone, thioguanine, procarabizine, and cytarabine.

Non-limiting exemplary antivirals that can be conjugated to any of the ACCs described herein include: acyclovir, vira A, and symmetrel.

Non-limiting exemplary antifungals that can be conjugated to any of the ACCs described herein include: nystatin.

Non-limiting exemplary conjugatable detection reagents that can be conjugated to any of the ACCs described herein include: fluorescein and derivatives thereof, fluorescein isothiocyanate (FITC).

Non-limiting exemplary antibacterials that can be conjugated to any of the activatable cytokine constructs described herein include: aminoglycosides, streptomycin, neomycin, kanamycin, amikacin, gentamicin, and tobramycin.

Non-limiting exemplary 3beta,16beta,17alpha-trihydroxycholest-5-en-22-one 16-O-(2-O-4-methoxybenzoyl-beta-D-xylopyranosyl)-(1→3)-(2-O-acetyl-alpha-L-arabinopyranoside) (OSW-1) that can be conjugated to any of the activatable cytokine constructs described herein include: s-nitrobenzyloxycarbonyl derivatives of 06-benzylguanine, toposisomerase inhibitors, hemiasterlin, cephalotaxine, homoharringionine, pyrrol obenzodiazepine dimers (PBDs), functionalized pyrrolobenzodiazepenes, calcicheamicins, podophyiitoxins, taxanes, and vinca alkoids.

Non-limiting exemplary radiopharmaceuticals that can be conjugated to any of the activatable cytokine constructs described herein include: $^{123}$I, $^{89}$Zr, $^{125}$I, $^{131}$I, $^{99m}$Tc, $^{201}$Tl, $^{62}$Cu, $^{18}$F, $^{68}$Ga, $^{13}$N, $^{15}$O, $^{38}$K, $^{82}$Rb, $^{111}$In, $^{133}$Xe, and $^{99m}$Tc (Technetium).

Non-limiting exemplary heavy metals that can be conjugated to any of the ACCs described herein include: barium, gold, and platinum.

Non-limiting exemplary anti-mycoplasmals that can be conjugated to any of the ACCs described herein include: tylosine, spectinomycin, streptomycin B, ampicillin, sulfanilamide, polymyxin, and chloramphenicol.

Those of ordinary skill in the art will recognize that a large variety of possible moieties can be conjugated to any of the activatable cytokine constructs described herein. Conjugation can include any chemical reaction that will bind the two molecules so long as the ACC and the other moiety retain their respective activities. Conjugation can include many chemical mechanisms, e.g., covalent binding, affinity binding, intercalation, coordinate binding, and complexation. In some embodiments, the preferred binding is covalent binding. Covalent binding can be achieved either by direct condensation of existing side chains or by the incorporation of external bridging molecules. Many bivalent or polyvalent linking agents are useful in conjugating any of the activatable cytokine constructs described herein. For example, conjugation can include organic compounds, such as thioesters, carbodiimides, succinimide esters, glutaraldehyde, diazobenzenes, and hexamethylene diamines. In some embodiments, the activatable cytokine construct can include, or otherwise introduce, one or more non-natural amino acid residues to provide suitable sites for conjugation.

In some embodiments of any of the ACCs described herein, an agent and/or conjugate is attached by disulfide bonds (e.g., disulfide bonds on a cysteine molecule) to the antigen-binding domain. Since many cancers naturally release high levels of glutathione, a reducing agent, glutathione present in the cancerous tissue microenvironment can reduce the disulfide bonds, and subsequently release the agent and/or the conjugate at the site of delivery.

In some embodiments of any of the ACCs described herein, when the conjugate binds to its target in the presence of complement within the target site (e.g., diseased tissue (e.g., cancerous tissue)), the amide or ester bond attaching the conjugate and/or agent to the linker is cleaved, resulting in the release of the conjugate and/or agent in its active form. These conjugates and/or agents when administered to a subject, will accomplish delivery and release of the conjugate and/or the agent at the target site (e.g., diseased tissue (e.g., cancerous tissue)). These conjugates and/or agents are particularly effective for the in vivo delivery of any of the conjugates and/or agents described herein.

In some embodiments, the linker is not cleavable by enzymes of the complement system. For example, the conjugate and/or agent is released without complement activation since complement activation ultimately lyses the target cell. In such embodiments, the conjugate and/or agent is to be delivered to the target cell (e.g., hormones, enzymes, corticosteroids, neurotransmitters, or genes). Furthermore, the linker is mildly susceptible to cleavage by serum proteases, and the conjugate and/or agent is released slowly at the target site.

In some embodiments of any of the ACCs described herein, the conjugate and/or agent is designed such that the conjugate and/or agent is delivered to the target site (e.g., disease tissue (e.g., cancerous tissue)) but the conjugate and/or agent is not released.

In some embodiments of any of the ACCs described herein, the conjugate and/or agent is attached to an antigen-binding domain either directly or via a non-cleavable linker. Exemplary non-cleavable linkers include amino acids (e.g., D-amino acids), peptides, or other organic compounds that may be modified to include functional groups that can subsequently be utilized in attachment to antigen-binding domains by methods described herein.

In some embodiments of any of the ACCs described herein, an ACC includes at least one point of conjugation for an agent. In some embodiments, all possible points of conjugation are available for conjugation to an agent. In some embodiments, the one or more points of conjugation include, without limitation, sulfur atoms involved in disulfide bonds, sulfur atoms involved in interchain disulfide bonds, sulfur atoms involved in interchain sulfide bonds but not sulfur atoms involved in intrachain disulfide bonds, and/or sulfur atoms of cysteine or other amino acid residues containing a sulfur atom. In such cases, residues may occur naturally in the protein construct structure or may be incorporated into the protein construct using methods including, without limitation, site-directed mutagenesis, chemical conversion, or mis-incorporation of non-natural amino acids.

This disclosure also provides methods and materials for preparing an ACC for conjugation. In some embodiments of any of the ACCs described herein, an ACC is modified to include one or more interchain disulfide bonds. For example, disulfide bonds in the ACC can undergo reduction following exposure to a reducing agent such as, without limitation, TCEP, DTT, or β-mercaptoethanol. In some cases, the reduction of the disulfide bonds is only partial. As used herein, the term partial reduction refers to situations where an ACC is contacted with a reducing agent and a fraction of all possible sites of conjugation undergo reduction (e.g., not all disulfide bonds are reduced). In some embodiments, an activatable cytokine construct is partially reduced following contact with a reducing agent if less than 99%, (e.g., less than 98%, 97%, 96%, 95%, 90%, 85%, 80%, 75%, 70%, 65%, 60%, 55%, 50%, 45%, 40%, 35%, 30%, 25%, 20%, 15%, 10% or less than 5%) of all possible sites of conjugation are reduced. In some embodiments, the ACC having a reduction in one or more interchain disulfide bonds is conjugated to a drug reactive with free thiols.

This disclosure also provides methods and materials for conjugating a therapeutic agent to a particular location on an ACC. In some embodiments of any of the ACC described herein, an ACC is modified so that the therapeutic agents can be conjugated to the ACC at particular locations on the ACC. For example, an ACC can be partially reduced in a manner that facilitates conjugation to the ACC. In such cases, partial reduction of the ACC occurs in a manner that conjugation sites in the ACC are not reduced. In some embodiments, the conjugation site(s) on the ACC are selected to facilitate conjugation of an agent at a particular location on the protein construct. Various factors can influence the "level of reduction" of the ACC upon treatment with a reducing agent. For example, without limitation, the ratio of reducing agent to ACC, length of incubation, incubation temperature, and/or pH of the reducing reaction solution can require optimization in order to achieve partial reduction of the ACC with the methods and materials described herein. Any appropriate combination of factors (e.g., ratio of reducing agent to ACC, the length and temperature of incubation with reducing agent, and/or pH of reducing agent) can be used to achieve partial reduction of the ACC (e.g., general reduction of possible conjugation sites or reduction at specific conjugation sites).

An effective ratio of reducing agent to ACC can be any ratio that at least partially reduces the ACC in a manner that allows conjugation to an agent (e.g., general reduction of possible conjugation sites or reduction at specific conjugation sites). In some embodiments, the ratio of reducing agent to ACC will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

An effective incubation time and temperature for treating an ACC with a reducing agent can be any time and temperature that at least partially reduces the ACC in a manner that allows conjugation of an agent to an ACC (e.g., general reduction of possible conjugation sites or reduction at specific conjugation sites). In some embodiments, the incubation time and temperature for treating an ACC will be in a range from about 1 hour at 37° C. to about 12 hours at 37° C. (or any subranges therein).

An effective pH for a reduction reaction for treating an ACC with a reducing agent can be any pH that at least partially reduces the ACC in a manner that allows conjugation of the ACC to an agent (e.g., general reduction of possible conjugation sites or reduction at specific conjugation sites).

When a partially-reduced ACC is contacted with an agent containing thiols, the agent can conjugate to the interchain thiols in the ACC. An agent can be modified in a manner to include thiols using a thiol-containing reagent (e.g., cysteine or N-acetyl cysteine). For example, the ACC can be partially reduced following incubation with reducing agent (e.g., TEPC) for about 1 hour at about 37° C. at a desired ratio of reducing agent to ACC. An effective ratio of reducing agent to ACC can be any ratio that partially reduces at least two interchain disulfide bonds located in the ACC in a manner that allows conjugation of a thiol-containing agent (e.g., general reduction of possible conjugation sites or reduction at specific conjugation sites).

In some embodiments of any of the ACCs described herein, an ACC is reduced by a reducing agent in a manner that avoids reducing any intrachain disulfide bonds. In some embodiments of any of the ACCs described herein, an ACC is reduced by a reducing agent in a manner that avoids reducing any intrachain disulfide bonds and reduces at least one interchain disulfide bond.

In some embodiments of any of the ACCs described herein, the ACC can also include an agent conjugated to the ACC. In some embodiments, the conjugated agent is a therapeutic agent.

In some embodiments, the agent (e.g., agent conjugated to an activatable cytokine construct) is a detectable moiety such as, for example, a label or other marker. For example, the agent is or includes a radiolabeled amino acid, one or more biotinyl moieties that can be detected by marked avidin (e.g., streptavidin containing a fluorescent marker or enzymatic activity that can be detected by optical or calorimetric methods), one or more radioisotopes or radionuclides, one or more fluorescent labels, one or more enzymatic labels, and/or one or more chemiluminescent agents. In some embodiments, detectable moieties are attached by spacer molecules.

In some embodiments, the agent (e.g., cytotoxic agent conjugated to an activatable cytokine construct) is linked to the ACC using a carbohydrate moiety, sulfhydryl group, amino group, or carboxylate group.

In some embodiments of any of the ACCs described herein conjugated to an agent, the agent (e.g., cytotoxic agent conjugated to an activatable cytokine construct) is conjugated to the ACC via a linker and/or a CM (also referred to as a cleavable sequence). In some embodiments, the agent (e.g., cytotoxic agent conjugated to an activatable cytokine construct) is conjugated to a cysteine or a lysine in the ACC. In some embodiments, the agent (e.g., cytotoxic agent conjugated to an activatable cytokine construct) is conjugated to another residue of the ACC, such as those residues disclosed herein. In some embodiments, the linker is a thiol-containing linker. Some non-limiting examples of the linker and/or CMs are provided in Table 1.

TABLE 1

| Types of Cleavable Sequences/CMs | Amino Acid Sequence |
|---|---|
| Plasmin CMs | |
| Pro-urokinase | PRFKIIGG (SEQ ID NO: 280) |
| | PRFRIIGG (SEQ ID NO: 281) |

TABLE 1-continued

| Types of Cleavable Sequences/CMs | Amino Acid Sequence |
|---|---|
| TGFβ | SSRHRRALD (SEQ ID NO: 282) |
| Plasminogen | RKSSIIIRMRDVVL (SEQ ID NO: 283) |
| Staphylokinase | SSSFDKGKYKKGDDA (SEQ ID NO: 284) |
|  | SSSFDKGKYKRGDDA (SEQ ID NO: 285) |
| Factor Xa CMs | IEGR (SEQ ID NO: 286) |
|  | IDGR (SEQ ID NO: 287) |
|  | GGSIDGR (SEQ ID NO: 288) |
| MMP CMs |  |
| Gelatinase A | PLGLWA (SEQ ID NO: 289) |
| Collagenase CMs |  |
| Calf skin collagen (α1(I) chain) | GPQGIAGQ (SEQ ID NO: 290) |
| Calf skin collagen (α2(I) chain) | GPQGLLGA (SEQ ID NO: 291) |
| Bovine cartilage collagen (α1(II) chain) | GIAGQ (SEQ ID NO: 292) |
| Human liver collagen (α1(III) chain) | GPLGIAGI (SEQ ID NO: 293) |
| Human α$_2$M | GPEGLRVG (SEQ ID NO: 294) |
| Human PZP | YGAGLGVV (SEQ ID NO: 295) |
|  | AGLGVVER (SEQ ID NO: 296) |
|  | AGLGISST (SEQ ID NO: 297) |
| Rat α$_1$M | EPQALAMS (SEQ ID NO: 298) |
|  | QALAMSAI (SEQ ID NO: 299) |
| Rat α$_2$M | AAYHLVSQ (SEQ ID NO: 300) |
|  | MDAFLESS (SEQ ID NO: 301) |
| Rat α$_1$I$_3$(2J) | ESLPVVAV (SEQ ID NO: 302) |
| Rat α$_1$I$_3$(27J) | SAPAVESE (SEQ ID NO: 303) |
| Human fibroblast collagenase | DVAQFVLT (SEQ ID NO: 304) |
| (autolytic cleavages) | VAQFVLT (SEQ ID NO: 305) |
|  | VAQFVLTE (SEQ ID NO: 306) |
|  | AQFVLTEG (SEQ ID NO: 307) |
|  | PVQPIGPQ (SEQ ID NO: 308) |

Those of ordinary skill in the art will recognize that a large variety of possible moieties can be coupled to the ACCs of the disclosure. (See, for example, "Conjugate Vaccines", Contributions to Microbiology and Immunology, J. M. Cruse and R. E. Lewis, Jr (eds), Carger Press, New York, (1989), the entire contents of which are incorporated herein by reference). In general, an effective conjugation of an agent (e.g., cytotoxic agent) to an ACC can be accomplished by any chemical reaction that will bind the agent to the ACC while also allowing the agent and the ACC to retain functionality.

In some embodiments of any of the ACCs conjugated to an agent, a variety of bifunctional protein-coupling agents can be used to conjugate the agent to the ACC including, without limitation, N-succinimidyl-3-(2-pyridyldithiol) propionate (SPDP), iminothiolane (IT), bifunctional derivatives of imidoesters (e.g., dimethyl adipimidate HCL), active esters (e.g., disuccinimidyl suberate), aldehydes (e.g., glutareldehyde), bis-azido compounds (e.g., bis (p-azidobenzoyl) hexanediamine), bis-diazonium derivatives (e.g., bis-(p-diazoniumbenzoyl)-ethylenediamine), diisocyanates (e.g., tolyene 2,6-diisocyanate), and bis-active fluorine compounds (e.g., 1,5-difluoro-2,4-dinitrobenzene). For example, a ricin immunotoxin can be prepared as described in Vitetta et al., Science 238: 1098 (1987). In some embodiments, a carbon-14-labeled 1-isothiocyanatobenzyl-3-methyldiethylene triaminepentaacetic acid (MX-DTPA) chelating agent can be used to conjugate a radionucleotide to the ACC. (See, e.g., WO94/11026).

Suitable linkers and CMs are described in the literature. (See, for example, Ramakrishnan, S. et al., Cancer Res. 44:201-208 (1984) describing use of MBS (M-maleimidobenzoyl-N-hydroxysuccinimide ester). See also, U.S. Pat. No. 5,030,719, describing use of halogenated acetyl hydrazide derivative coupled to an ACC by way of an oligopeptide linker. In some embodiments, suitable linkers include: (i) EDC (1-ethyl-3-(3-dimethylamino-propyl) carbodiimide hydrochloride; (ii) SMPT (4-succinimidyloxycarbonyl-alpha-methyl-alpha-(2-pridyl-dithio)-toluene (Pierce Chem. Co., Cat. (21558G); (iii) SPDP (succinimidyl-6 [3-(2-pyridyldithio) propionamido] hexanoate (Pierce Chem. Co., Cat #21651G); (iv) Sulfo-LC-SPDP (sulfosuccinimidyl 6 [3-(2-pyridyldithio)-propianamide] hexanoate (Pierce Chem. Co. Cat. #2165-G); and (v) sulfo-NHS (N-hydroxysulfo-succinimide: Pierce Chem. Co., Cat. #24510) conjugated to EDC. Additional linkers include, but are not limited to, SMCC, sulfo-SMCC, SPDB, or sulfo-SPDB.

The linkers and CMs described above contain components that have different attributes, thus leading to conjugates with differing physio-chemical properties. For example, sulfo-NHS esters of alkyl carboxylates are more stable than sulfo-NHS esters of aromatic carboxylates. NHS-ester containing linkers are less soluble than sulfo-NHS esters. Further, the linker SMPT contains a sterically-hindered disulfide bond, and can form conjugates with increased stability. Disulfide linkages, are in general, less stable than other linkages because the disulfide linkage is cleaved in vitro, resulting in less conjugate available. Sulfo-NHS, in particular, can enhance the stability of carbodimide couplings. Carbodimide couplings (such as EDC) when used in conjunction with sulfo-NHS, forms esters that are more resistant to hydrolysis than the carbodimide coupling reaction alone.

In some embodiments of any of the ACCs, an agent can be conjugated to the ACC using a modified amino acid sequence included in the amino acid sequence of the ACC.

By inserting conjugation-enabled amino acids at specific locations within the amino acid sequence of the ACC, the protein construct can be designed for controlled placement and/or dosage of the conjugated agent (e.g., cytotoxic agent). For example, the ACC can be modified to include a cysteine amino acid residue at positions on the first monomer, the second monomer, the third monomer, and/or the fourth monomer that provide reactive thiol groups and does not negatively impact protein folding and/or assembly and does not alter antigen-binding properties. In some embodiments, the ACC can be modified to include one or more non-natural amino acid residues within the amino acid sequence of the ACC to provide suitable sites for conjugation. In some embodiments, the ACC can be modified to include enzymatically activatable peptide sequences within the amino acid sequence of the ACC.

Nucleic Acids

Provided herein are nucleic acids including sequences that encode the first monomer construct (or the protein portion of the first monomer construct) (e.g., any of the first monomers constructs described herein) and the second monomer construct (or the protein portion of the second monomer construct) (e.g., any of the second monomer constructs described herein) of any of the ACCs described herein. In some embodiments, a pair of nucleic acids together encode the first monomer construct (or the protein portion of the first monomer construct) and the second monomer construct (or the protein portion of the second monomer construct). In some embodiments, the nucleic acid sequence encoding the first monomer construct (or the protein portion of the first monomer construct) is at least 70% identical (e.g., at least 72% identical, at least 74% identical, at least 76% identical, at least 78% identical, at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical) to the nucleic acid sequence encoding the second monomer construct (or the protein portion of the second monomer construct).

In some embodiments, the nucleic acid encoding the protein portion of a first monomer construct encodes a polypeptide comprising the PM1, CP1, CM1, and CM3 moieties. In some embodiments, the nucleic acid encoding the protein portion of a second monomer encodes a polypeptide comprising the CP2 and CM2 moieties. In some embodiments, the nucleic acid encoding the protein portion of a second monomer encodes a polypeptide comprising the CP2, CM2, PM2, and CM4 moieties. In some embodiments, a pair of nucleic acids together encode the protein portion of a first monomer construct and the protein portion of the second monomer construct, wherein the protein portions are then conjugated to the DD1 and DD2 moieties, respectively (in a subsequent conjugation step).

In some embodiments, the nucleic acid encoding the first monomer construct encodes a polypeptide comprising the DD1 moiety. In some embodiments, the nucleic acid encoding the second monomer construct encodes a polypeptide comprising the DD2 moiety.

Vectors

Provided herein are vectors and sets of vectors including any of the nucleic acids described herein. One skilled in the art will be capable of selecting suitable vectors or sets of vectors (e.g., expression vectors) for making any of the ACCs described herein, and using the vectors or sets of vectors to express any of the ACCs described herein. For example, in selecting a vector or a set of vectors, the cell must be considered because the vector(s) may need to be able to integrate into a chromosome of the cell and/or replicate in it. Exemplary vectors that can be used to produce an ACC are also described below.

As used herein, the term "vector" refers to a polynucleotide capable of inducing the expression of a recombinant protein (e.g., a first or second monomer) in a cell (e.g., any of the cells described herein). A "vector" is able to deliver nucleic acids and fragments thereof into a host cell, and includes regulatory sequences (e.g., promoter, enhancer, poly(A) signal). Exogenous polynucleotides may be inserted into the expression vector in order to be expressed. The term "vector" also includes artificial chromosomes, plasmids, retroviruses, and baculovirus vectors.

Methods for constructing suitable vectors that include any of the nucleic acids described herein, and suitable for transforming cells (e.g., mammalian cells) are well-known in the art. See, e.g., Sambrook et al., Eds. "Molecular Cloning: A Laboratory Manual," $2^{nd}$ Ed., Cold Spring Harbor Press, 1989 and Ausubel et al., Eds. "Current Protocols in Molecular Biology," Current Protocols, 1993.

Non-limiting examples of vectors include plasmids, transposons, cosmids, and viral vectors (e.g., any adenoviral vectors (e.g., pSV or pCMV vectors), adeno-associated virus (AAV) vectors, lentivirus vectors, and retroviral vectors), and any Gateway® vectors. A vector can, for example, include sufficient cis-acting elements for expression; other elements for expression can be supplied by the host mammalian cell or in an in vitro expression system. Skilled practitioners will be capable of selecting suitable vectors and mammalian cells for making any of the ACCs described herein.

In some embodiments of any of the ACCs described herein, the ACC may be made biosynthetically using recombinant DNA technology and expression in eukaryotic or prokaryotic species.

In some embodiments, the vector includes a nucleic acid encoding the first monomer and the second monomer of any of the ACCs described herein. In some embodiments, the vector is an expression vector.

In some embodiments, a pair of vectors together include a pair of nucleic acids that together encode the first monomer and the second monomer of any of the ACCs described herein. In some embodiments, the pair of vectors is a pair of expression vectors.

Cells

Also provided herein are host cells including any of the vector or sets of vectors described herein including any of the nucleic acids described herein.

Any of the ACCs described herein can be produced by any cell (e.g., a mammalian cell). In some embodiments, a host cell is a mammalian cell (e.g., a human cell), a rodent cell (e.g., a mouse cell, a rat cell, a hamster cell, or a guinea pig cell), or a non-human primate cell.

Methods of introducing nucleic acids and vectors (e.g., any of the vectors or any of the sets of vectors described herein) into a cell are known in the art. Non-limiting examples of methods that can be used to introducing a nucleic acid into a cell include: lipofection, transfection, calcium phosphate transfection, cationic polymer transfection, viral transduction (e.g., adenoviral transduction, lentiviral transduction), nanoparticle transfection, and electroporation.

In some embodiments, the introducing step includes introducing into a cell a vector (e.g., any of the vectors or sets of vectors described herein) including a nucleic acid encoding the monomers that make up any of the ACCs described herein.

In some embodiments of any of the methods described herein, the cell can be a eukaryotic cell. As used herein, the term "eukaryotic cell" refers to a cell having a distinct, membrane-bound nucleus. Such cells may include, for example, mammalian (e.g., rodent, non-human primate, or human), insect, fungal, or plant cells. In some embodiments, the eukaryotic cell is a yeast cell, such as *Saccharomyces cerevisiae*. In some embodiments, the eukaryotic cell is a higher eukaryote, such as mammalian, avian, plant, or insect cells. Non-limiting examples of mammalian cells include Chinese hamster ovary (CHO) cells and human embryonic kidney cells (e.g., HEK293 cells).

In some embodiments, the cell contains the nucleic acid encoding the first monomer and the second monomer of any one of the ACCs described herein. In some embodiments, the cell contains the pair of nucleic acids that together encode the first monomer and the second monomer of any of the ACCs described herein.

Methods of Producing Activatable Cytokine Constructs

Provided herein are methods of producing any of the ACCs described herein that include: (a) culturing any of the recombinant host cells described herein in a liquid culture medium under conditions sufficient to produce the ACC; and (b) recovering the ACC from the host cell and/or the liquid culture medium.

Methods of culturing cells are well known in the art. Cells can be maintained in vitro under conditions that favor cell proliferation, cell differentiation and cell growth. For example, cells can be cultured by contacting a cell (e.g., any of the cells described herein) with a cell culture medium that includes the necessary growth factors and supplements sufficient to support cell viability and growth.

In some embodiments of any of the methods described herein, the method further includes isolating the recovered ACC. Non-limiting examples of methods of isolation include: ammonium sulfate precipitation, polyethylene glycol precipitation, size exclusion chromatography, ligand-affinity chromatography, ion-exchange chromatography (e.g., anion or cation), and hydrophobic interaction chromatography.

In some embodiments, the cells can produce a protein portion of a first monomer construct that includes the CP1, the CM1, the PM2, and the CM3, and a protein portion of a second monomer construct that includes the CP2, and the CM2, and optionally the PM2 and the CM4, and then the protein portions are subsequently conjugated to the DD1 and DD2 moieties, respectively.

Compositions and methods described herein may involve use of non-reducing or partially-reducing conditions that allow disulfide bonds to form between the dimerization domains to form and maintain dimerization of the ACCs.

In some embodiments of any of the methods described herein, the method further includes formulating the isolated ACC into a pharmaceutical composition. Various formulations are known in the art and are described herein. Any of the isolated ACCs described herein can be formulated for any route of administration (e.g., intravenous, intratumoral, subcutaneous, intradermal, oral (e.g., inhalation), transdermal (e.g., topical), transmucosal, or intramuscular).

Also provided herein are ACCs produced by any of the methods described herein. Also provided are compositions (e.g., pharmaceutical compositions) that include any of the ACCs produced by any of the methods described herein.

Also provided herein are kits that include at least one dose of any of the compositions (e.g., pharmaceutical compositions) described herein.

Methods of Treatment

Provided herein are methods of treating a disease (e.g., a cancer (e.g., any of the cancers described herein)) in a subject including administering a therapeutically effective amount of any of the ACCs described herein to the subject.

As used herein, the term "subject" refers to any mammal. In some embodiments, the subject is a feline (e.g., a cat), a canine (e.g., a dog), an equine (e.g., a horse), a rabbit, a pig, a rodent (e.g., a mouse, a rat, a hamster or a guinea pig), a non-human primate (e.g., a simian (e.g., a monkey (e.g., a baboon, a marmoset), or an ape (e.g., a chimpanzee, a gorilla, an orangutan, or a gibbon)), or a human. In some embodiments, the subject is a human.

In some embodiments, the subject has been previously identified or diagnosed as having the disease (e.g., cancer (e.g., any of the cancers described herein)).

As used herein, the term "treat" includes reducing the severity, frequency or the number of one or more (e.g., 1, 2, 3, 4, or 5) symptoms or signs of a disease (e.g., a cancer (e.g., any of the cancers described herein)) in the subject (e.g., any of the subjects described herein). In some embodiments where the disease is cancer, treating results in reducing cancer growth, inhibiting cancer progression, inhibiting cancer metastasis, or reducing the risk of cancer recurrence in a subject having cancer.

In some embodiments, the methods and uses of the present disclosure include any route of administration including intravenous, infusion, intratumoral, subcutaneous, intraperitoneal, intradermal, oral (e.g., inhalation), intranasal, transdermal (e.g., topical), transmucosal, and/or intramuscular.

In some embodiments of any of the methods described herein, the disease is a cancer. Also provided herein are methods of treating a subject in need thereof (e.g., any of the exemplary subjects described herein or known in the art) that include administering to the subject a therapeutically effective amount of any of the ACCs described herein or any of the compositions (e.g., pharmaceutical compositions) described herein.

In some embodiments of these methods, the subject has been identified or diagnosed as having a cancer. Non-limiting examples of cancer include: solid tumor, hematological tumor, sarcoma, osteosarcoma, glioblastoma, neuroblastoma, melanoma, rhabdomyosarcoma, Ewing sarcoma, osteosarcoma, B-cell neoplasms, multiple myeloma, a lymphoma (e.g., B-cell lymphoma, B-cell non-Hodgkin's lymphoma, Hodgkin's lymphoma, cutaneous T-cell lymphoma), a leukemia (e.g., hairy cell leukemia, chronic lymphocytic leukemia (CLL), acute myeloid leukemia (AML), chronic myeloid leukemia (CML), acute lymphocytic leukemia (ALL)), myelodysplastic syndromes (MDS), Kaposi sarcoma, retinoblastoma, stomach cancer, urothelial carcinoma, lung cancer, renal cell carcinoma, gastric and esophageal cancer, pancreatic cancer, prostate cancer, brain cancer, colon cancer, bone cancer, lung cancer, breast cancer including triple negative breast cancer (TNBC), colorectal cancer, ovarian cancer, nasopharyngeal adenocarcimoa, non-small cell lung carcinoma (NSCLC), squamous cell head and neck carcinoma, endometrial cancer, bladder cancer, cervical cancer, liver cancer, and hepatocellular carcinoma. In some embodiments, the cancer is a lymphoma. In some embodiments, the lymphoma is Burkitt's lymphoma. In some aspects, the subject has been identified or diagnosed as having familial cancer syndromes such as Li Fraumeni Syndrome, Familial Breast-Ovarian Cancer (BRCA1 or BRAC2 mutations) Syndromes, and others. The disclosed methods are also useful in treating non-solid cancers. Exemplary solid tumors include malignancies (e.g., sarcomas, adenocarcinomas, and carcinomas) of the various organ systems, such as those of lung, breast, lymphoid, gastrointestinal (e.g., colon), and genitourinary (e.g., renal, urothelial, or testicular tumors) tracts, pharynx, prostate, and ovary. Exemplary adenocarcinomas include colorectal cancers, renal-cell carcinoma, liver cancer, non-small cell carcinoma of the lung, and cancer of the small intestine.

Exemplary cancers described by the National Cancer Institute include: Acute Lymphoblastic Leukemia, Adult; Acute Lymphoblastic Leukemia, Childhood; Acute Myeloid Leukemia, Adult; Adrenocortical Carcinoma; Adrenocortical Carcinoma, Childhood; AIDS-Related Lymphoma; AIDS-Related Malignancies; Anal Cancer; Astrocytoma, Childhood Cerebellar; Astrocytoma, Childhood Cerebral; Bile Duct Cancer, Extrahepatic; Bladder Cancer; Bladder Cancer, Childhood; Bone Cancer, Osteosarcoma/Malignant Fibrous Histiocytoma; Brain Stem Glioma, Childhood; Brain Tumor, Adult; Brain Tumor, Brain Stem Glioma, Childhood; Brain Tumor, Cerebellar Astrocytoma, Childhood; Brain Tumor, Cerebral Astrocytoma/Malignant Glioma, Childhood; Brain Tumor, Ependymoma, Childhood; Brain Tumor, Medulloblastoma, Childhood; Brain Tumor, Supratentorial Primitive Neuroectodermal Tumors, Childhood; Brain Tumor, Visual Pathway and Hypothalamic Glioma, Childhood; Brain Tumor, Childhood (Other); Breast Cancer; Breast Cancer and Pregnancy; Breast Cancer, Childhood; Breast Cancer, Male; Bronchial Adenomas/Carcinoids, Childhood; Carcinoid Tumor, Childhood; Carcinoid Tumor, Gastrointestinal; Carcinoma, Adrenocortical; Carcinoma, Islet Cell; Carcinoma of Unknown Primary; Central Nervous System Lymphoma, Primary; Cerebellar Astrocytoma, Childhood; Cerebral Astrocytoma/Malignant Glioma, Childhood; Cervical Cancer; Childhood Cancers; Chronic Lymphocytic Leukemia; Chronic Myelogenous Leukemia; Chronic Myeloproliferative Disorders; Clear Cell Sarcoma of Tendon Sheaths; Colon Cancer; Colorectal Cancer, Childhood; Cutaneous T-Cell Lymphoma; Endometrial Cancer; Ependymoma, Childhood; Epithelial Cancer, Ovarian; Esophageal Cancer; Esophageal Cancer, Childhood; Ewing's Family of Tumors; Extracranial Germ Cell Tumor, Childhood; Extragonadal Germ Cell Tumor; Extrahepatic Bile Duct Cancer; Eye Cancer, Intraocular Melanoma; Eye Cancer, Retinoblastoma; Gallbladder Cancer; Gastric (Stomach) Cancer; Gastric (Stomach) Cancer, Childhood; Gastrointestinal Carcinoid Tumor; Germ Cell Tumor, Extracranial, Childhood; Germ Cell Tumor, Extragonadal; Germ Cell Tumor, Ovarian; Gestational Trophoblastic Tumor; Glioma, Childhood Brain Stem; Glioma, Childhood Visual Pathway and Hypothalamic; Hairy Cell Leukemia; Head and Neck Cancer; Hepatocellular (Liver) Cancer, Adult (Primary); Hepatocellular (Liver) Cancer, Childhood (Primary); Hodgkin's Lymphoma, Adult; Hodgkin's Lymphoma, Childhood; Hodgkin's Lymphoma During Pregnancy; Hypopharyngeal Cancer; Hypothalamic and Visual Pathway Glioma, Childhood; Intraocular Melanoma; Islet Cell Carcinoma (Endocrine Pancreas); Kaposi's Sarcoma; Kidney Cancer; Laryngeal Cancer; Laryngeal Cancer, Childhood; Leukemia, Acute Lymphoblastic, Adult; Leukemia, Acute Lymphoblastic, Childhood; Leukemia, Acute Myeloid, Adult; Leukemia, Acute Myeloid, Childhood; Leukemia, Chronic Lymphocytic; Leukemia, Chronic Myelogenous; Leukemia, Hairy Cell; Lip and Oral Cavity Cancer; Liver Cancer, Adult (Primary); Liver Cancer, Childhood (Primary); Lung Cancer, Non-Small Cell; Lung Cancer, Small Cell; Lymphoblastic Leukemia, Adult Acute; Lymphoblastic Leukemia, Childhood Acute; Lymphocytic Leukemia, Chronic; Lymphoma, AIDS-Related; Lymphoma, Central Nervous System (Primary); Lymphoma, Cutaneous T-Cell; Lymphoma, Hodgkin's, Adult; Lymphoma, Hodgkin's, Childhood; Lymphoma, Hodgkin's During Pregnancy; Lymphoma, Non-Hodgkin's, Adult; Lymphoma, Non-Hodgkin's, Childhood; Lymphoma, Non-Hodgkin's During Pregnancy; Lymphoma, Primary Central Nervous System; Macroglobulinemia, Waldenstrom's; Male Breast Cancer; Malignant Mesothelioma, Adult; Malignant Mesothelioma, Childhood; Malignant Thymoma; Medulloblastoma, Childhood; Melanoma; Melanoma, Intraocular; Merkel Cell Carcinoma; Mesothelioma, Malignant; Metastatic Squamous Neck Cancer with Occult Primary; Multiple Endocrine Neoplasia Syndrome, Childhood; Multiple Myeloma/Plasma Cell Neoplasm; Mycosis Fungoides; Myelodysplastic Syndromes; Myelogenous Leukemia, Chronic; Myeloid Leukemia, Childhood Acute; Myeloma, Multiple; Myeloproliferative Disorders, Chronic; Nasal Cavity and Paranasal Sinus Cancer; Nasopharyngeal Cancer; Nasopharyngeal Cancer, Childhood; Neuroblastoma; Non-Hodgkin's Lymphoma, Adult; Non-Hodgkin's Lymphoma, Childhood; Non-Hodgkin's Lymphoma During Pregnancy; Non-Small Cell Lung Cancer; Oral Cancer, Childhood; Oral Cavity and Lip Cancer; Oropharyngeal Cancer; Osteosarcoma/Malignant Fibrous Histiocytoma of Bone; Ovarian Cancer, Childhood; Ovarian Epithelial Cancer; Ovarian Germ Cell Tumor; Ovarian Low Malignant Potential Tumor; Pancreatic Cancer; Pancreatic Cancer, Childhood; Pancreatic Cancer, Islet Cell; Paranasal Sinus and Nasal Cavity Cancer; Parathyroid Cancer; Penile Cancer; Pheochromocytoma; Pineal and Supratentorial Primitive Neuroectodermal Tumors, Childhood; Pituitary Tumor; Plasma Cell Neoplasm/Multiple Myeloma; Pleuropulmonary Blastoma; Pregnancy and Breast Cancer; Pregnancy and Hodgkin's Lymphoma; Pregnancy and Non-Hodgkin's Lymphoma; Primary Central Nervous System Lymphoma; Primary Liver Cancer, Adult; Primary Liver Cancer, Childhood; Prostate Cancer; Rectal Cancer; Renal Cell (Kidney) Cancer; Renal Cell Cancer, Childhood; Renal Pelvis and Ureter, Transitional Cell Cancer; Retinoblastoma; Rhabdomyosarcoma, Childhood; Salivary Gland Cancer; Salivary Gland Cancer, Childhood; Sarcoma, Ewing's Family of Tumors; Sarcoma, Kaposi's; Sarcoma (Osteosarcoma)/Malignant Fibrous Histiocytoma of Bone; Sarcoma, Rhabdomyosarcoma, Childhood; Sarcoma, Soft Tissue, Adult; Sarcoma, Soft Tissue, Childhood; Sezary Syndrome; Skin Cancer; Skin Cancer, Childhood; Skin Cancer (Melanoma); Skin Carcinoma, Merkel Cell; Small Cell Lung Cancer; Small Intestine Cancer; Soft Tissue Sarcoma, Adult; Soft Tissue Sarcoma, Childhood; Squamous Neck Cancer with Occult Primary, Metastatic; Stomach (Gastric) Cancer; Stomach (Gastric) Cancer, Childhood; Supratentorial Primitive Neuroectodermal Tumors, Childhood; T-Cell Lymphoma, Cutaneous; Testicular Cancer; Thymoma, Childhood; Thymoma, Malignant; Thyroid Cancer; Thyroid Cancer, Childhood; Transitional Cell Cancer of the Renal Pelvis and Ureter; Trophoblastic Tumor, Gestational; Unknown Primary Site, Cancer of, Childhood; Unusual Cancers of Childhood; Ureter and Renal Pelvis, Transitional Cell Cancer; Urethral Cancer; Uterine Sarcoma; Vaginal Cancer; Visual Pathway and Hypothalamic Glioma, Childhood; Vulvar Cancer; Waldenstrom's Macro globulinemia; and Wilms' Tumor.

Further exemplary cancers include diffuse large B-cell lymphoma (DLBCL) and mantle cell lymphoma (MCL).

Metastases of the aforementioned cancers can also be treated or prevented in accordance with the methods described herein.

In some embodiments, these methods can result in a reduction in the number, severity, or frequency of one or more symptoms of the cancer in the subject (e.g., as compared to the number, severity, or frequency of the one or more symptoms of the cancer in the subject prior to treatment).

In some embodiments of any of the methods described herein, the methods further include administering to a subject an additional therapeutic agent (e.g., one or more of the therapeutic agents listed in Table 2).

TABLE 2

Additional Therapeutic Agents

| Antibody Trade Name (antibody name) | Target |
| --- | --- |
| Raptiva ™ (efalizumab) | CD11a |
| Arzerra ™ (ofatumumab) | CD20 |
| Bexxar ™ (tositumomab) | CD20 |
| Gazyva ™ (obinutuzumab) | CD20 |
| Ocrevus ™ (ocrelizumab) | CD20 |
| Rituxan ™ (rituximab) | CD20 |
| Zevalin ™ (ibritumomab tiuxetan) | CD20 |
| Adcetris ™ (brentuximab vedotin) | CD30 |
| Myelotarg ™ (gemtuzumab) | CD33 |
| Mylotarg ™ (gemtuzumab ozogamicin) | CD33 |
| (vadastuximab) | CD33 |
| (vadastuximab talirine) | CD33 |
| Campath ™ (alemtuzumab) | CD52 |
| Lemtrada ™ (alemtuzumab) | CD52 |
| Tactress ™ (tamtuvetmab) | CD52 |
| Soliris ™ (eculizumab) | Complement C5 |
| Ultomiris ™ (ravulizumab) | Complement C5 |
| (olendalizumab) | Complement C5 |
| Yervoy ™ (ipilimumab) | CTLA-4 |
| (tremelimumab) | CTLA-4 |
| Orencia ™ (abatacept) | CTLA-4 |
| Hu5c8 | CD40L |
| (letolizumab) | CD40L |
| Rexomun ™ (ertumaxomab) | CD3/Her2 |
| Erbitux ™ (cetuximab) | EGFR |
| Portrazza ™ (necitumumab) | EGFR |
| Vectibix ™ (panitumumab) | EGFR |
| CH806 | EGFR |
| (depatuxizumab) | EGFR |
| (depatuxizumab mafodotin) | EGFR |
| (futuximab:modotuximab) | EGFR |
| ICR62 (imgatuzumab) | EGFR |
| (laprituximab) | EGFR |
| (losatuxizumab) | EGFR |
| (losatuxizumab vedotin) | EGFR |
| mAb 528 | EGFR |
| (matuzumab) | EGFR |
| (nimotuzumab) | EGFR |
| (tomuzotuximab) | EGFR |
| (zalutumumab) | EGFR |
| MDX-447 | EGFR/CD64 |
| (adecatumumab) | EpCAM |
| Panorex ™ (edrecolomab) | EpCAM |
| Vicinium ™ | EpCAM |
| Synagis ™ (palivizumab) | F protein of RSV |
| ReoPro ™ (abiciximab) | Glycoprotein receptor IIb/IIIa |
| Herceptin ™ (trastuzumab) | Her2 |
| Herceptin ™ Hylecta (trastuzumab; Hyaluronidase) | Her2 |
| (trastuzumab deruxtecan) | Her2 |
| (hertuzumab verdotin) | Her2 |
| Kadcyla ™ (trastuzumab emtansine) | Her2 |
| (margetuximab) | Her2 |
| (timigutuzumab) | Her2 |
| Xolair ™ (omalizumab) | IgE |
| (ligelizumab) | IgE |

TABLE 2-continued

Additional Therapeutic Agents

| Antibody Trade Name (antibody name) | Target |
| --- | --- |
| (figitumumab) | IGF1R |
| (teprotumumab) | IGF1R |
| Simulect ™ (basiliximab) | IL2R |
| Zenapax ™ (daclizumab) | IL2R |
| Zinbryta ™ (daclizumab) | IL2R |
| Actemra ™ (tocilizumab) | IL-6 receptor |
| Kevzara ™ (sarilumab) | IL-6 receptor |
| (vobarilizumab) | IL-6 receptor |
| Stelara ™ (ustekinumab) | IL-12/IL-23 |
| Tysabri ™ (natalizumab) | Integrinα4 |
| (abrilumab) | Integrinα4 |
| | Jagged 1 or Jagged 2 |
| (fasinumab) | NGF |
| (fulranumab) | NGF |
| (tanezumab) | NGF |
| | Notch, e.g., Notch 1 |
| Pidilizumab | Delta like-1 (PD-1 pathway inhibitor) |
| Opdivo ® (nivolumab) | PD1 |
| Keytruda ® (pembrolizumab) | PD1 |
| Libtayo ® (cemiplimab) | PD1 |
| BGB-A317 (tislelizumab) | PD1 |
| PDR001 (spartalizumab) | PD1 |
| JNJ-63723283 (cetrelimab) | PD1 |
| TSR042 (dostarlimab) | PD1 |
| AGEN2034 (balstilimab) | PD1 |
| JS001 (toripalimab) | PD1 |
| IOBI308 (sintilimab) | PD1 |
| BCD100 (prolgolimab) | PD1 |
| CBT-501 (genolimzumab) | PD1 |
| ABBV181 (budigalimab) | PD1 |
| AK105 | PD1 |
| BI-754091 | PD1 |
| INCSHR-1210 | PD1 |
| MEDI0680 | PD1 |
| MGA012 | PD1 |
| SHR-1210 | PD1 |
| Imfinzi ™ (durvalumab) | PD-L1 |
| Tecentriq ® (atezolizumab) | PD-L1 |
| Bavencio ® (avelumab) | PD-L1 |
| KN035 (envafolimab) | PD-L1 |
| BMS936559 (MDX1105) | PD-L1 |
| BGBA 333 | PD-L1 |
| FAZ053 | PD-L1 |
| LY-3300054 | PD-L1 |
| SH-1316 | PD-L1 |
| AMP-224 | PD-L2 |
| (bavituximab) | Phosphatidylserine |
| huJ591 | PSMA |
| RAV12 | RAAG12 |
| Prolia ™ (denosumab) | RANKL |
| GC1008 (fresolimumab) | TGFbeta |
| Cimzia ™ (Certolizumab Pegol) | TNFα |
| Remicade ™ (infliximab) | TNFα |
| Humira ™ (adalimumab) | TNFα |
| Simponi ™ (golimumab) | TNFα |
| Enbrel ™ (etanercept) | TNF-R |
| (mapatumumab) | TRAIL-R1 |
| Avastin ™ (bevacizumab) | VEGF |
| Lucentis ™ (ranibizumab) | VEGF |
| (brolucizumab) | VEGF |
| (vanucizumab) | VEGF |

Compositions/Kits

Also provided herein are compositions (e.g., pharmaceutical compositions) including any of the ACCs described herein and one or more (e.g., 1, 2, 3, 4, or 5) pharmaceutically acceptable carriers (e.g., any of the pharmaceutically acceptable carriers described herein), diluents, or excipients.

In some embodiments, the compositions (e.g. pharmaceutical compositions) that include any of the ACCs described herein can be disposed in a sterile vial or a pre-loaded syringe.

In some embodiments, the compositions (e.g. pharmaceutical compositions) that include any of the ACCs described herein can be formulated for different routes of administration (e.g., intravenous, subcutaneous, intramuscular, intraperitoneal, or intratumoral).

In some embodiments, any of the pharmaceutical compositions described herein can include one or more buffers (e.g., a neutral-buffered saline, a phosphate-buffered saline (PBS), amino acids (e.g., glycine), one or more carbohydrates (e.g., glucose, mannose, sucrose, dextran, or mannitol), one or more antioxidants, one or more chelating agents (e.g., EDTA or glutathione), one or more preservatives, and/or a pharmaceutically acceptable carrier (e.g., bacteriostatic water, PBS, or saline).

As used herein, the phrase "pharmaceutically acceptable carrier" refers to any and all solvents, dispersion media, coatings, antibacterial agents, antimicrobial agents, isotonic and absorption delaying agents, and the like, compatible with pharmaceutical administration. Suitable carriers include, but are not limited to: water, saline, ringer's solutions, dextrose solution, and about 5% human serum albumin.

In some embodiments of any of the pharmaceutical compositions described herein, any of the ACCs described herein are prepared with carriers that protect against rapid elimination from the body, e.g., sustained and controlled release formulations, including implants and microencapsulated delivery systems. Biodegradable, biocompatible polymers can be used, e.g., ethylene vinyl acetate, polyanhydrides, polyglycolic acid, collage, polyorthoesters, and polylactic acid. Methods for preparation of such pharmaceutical compositions and formulations are apparent to those skilled in the art.

Also provided herein are kits that include any of the ACCs described herein, any of the compositions that include any of the ACCs described herein, or any of the pharmaceutical compositions that include any of the ACCs described herein. Also provided are kits that include one or more second therapeutic agent(s) selected from Table 2 in addition to an ACC described herein. The second therapeutic agent(s) may be provided in a dosage administration form that is separate from the ACC. Alternatively, the second therapeutic agent(s) may be formulated together with the ACC.

Any of the kits described herein can include instructions for using any of the compositions (e.g., pharmaceutical compositions) and/or any of the ACCs described herein. In some embodiments, the kits can include instructions for performing any of the methods described herein. In some embodiments, the kits can include at least one dose of any of the compositions (e.g., pharmaceutical compositions) described herein. In some embodiments, the kits can provide a syringe for administering any of the pharmaceutical compositions described herein.

The present disclosure includes and finds support for and in any one or any combination of the following items:

1. An activatable cytokine construct (ACC) that includes a first monomer construct and a second monomer construct, wherein:
(a) the first monomer construct comprises a first peptide mask (PM1), a first mature cytokine protein (CP1), a first and a third cleavable moieties (CM1 and CM3), and a first dimerization domain (DD1), wherein the CM1 is positioned between the CP1 and the DD1 and the CM3 is positioned between the PM1 and the CP1; and
(b) the second monomer construct comprises a second mature cytokine protein (CP2), a second cleavable moiety (CM2), and a second dimerization domain (DD2), wherein the CM2 is positioned between the CP2 and the DD2;
wherein the DD1 and the DD2 bind to each other thereby forming a dimer of the first monomer construct and the second monomer construct.

2. The ACC of item 1, wherein the second monomer construct further comprises a second peptide mask (PM2) and a fourth cleavable moiety (CM4), wherein the CM4 is positioned between the PM2 and the CP2.

3. The ACC of item 1 or 2, wherein the first monomer construct comprises a first polypeptide that comprises the PM1, the CM3, the CP1, the CM1, and the DD1, optionally wherein the first monomer construct comprises a structural arrangement in a N- to C-terminal direction of PM1-CM3-CP1-CM1-DD1, wherein each dash (—) between the ACC components represents either a direct linkage or linkage via one or more linkers.

4. The ACC of any one or combination of items 1-3, wherein the second monomer construct comprises a second polypeptide that comprises the CP2, the CM2, and the DD2.

5. The ACC of item 2, wherein the second monomer construct comprises a second polypeptide that comprises the PM2, the CM4, the CP2, the CM2, and the DD2, optionally wherein the second monomer construct comprises a structural arrangement in a N- to C-terminal direction of PM2-CM4-CP2-CM2-DD2.

6. The ACC of any one or combination of items 1-5, wherein the CP1 and/or the CP2 is/are each individually selected from the group consisting of: an interferon, an interleukin, GM-CSF, G-CSF, LIF, OSM, CD154, LT-$\beta$, TNF-$\alpha$, TNF-$\beta$, 4-1BBL, APRIL, CD70, CD153, CD178, GITRL, LIGHT, OX40L, TALL-1, TRAIL, TWEAK, TRANCE, TGF-$\beta$1, TGF-$\beta$1, TGF-$\beta$3, Epo, Tpo, Flt-3L, SCF, M-CSF, and MSP, optionally wherein the CP1 and/or the CP2 is independently selected from IL-2, IL-7, IL-8, IL-10, IL-12, IL-15, IL-21, an IFN-alpha, an IFN beta, an IFN gamma, GM-CSF, TGF-beta, LIGHT, GITR-L, CD40L, CD27L, 4-1BB-L, OX40, and OX40L.

7. The ACC of any one or combination of items 1-6, wherein:
the PM1 comprises a sequence selected from the group consisting of SEQ ID NOs: 328, 329, 323, and 331-369, and the CP1 is an interferon;
the PM1 comprises a sequence selected from the group consisting of SEQ ID NOs: 328, 329, 323, and 331-364, and the CP1 is an interferon alpha;
the PM1 comprises a sequence selected from the group consisting of SEQ ID NOs: 331-360, 362-364, and the CP1 is an interferon beta;
the PM1 comprises a sequence selected from the group consisting of SEQ ID NOs: 331-360, 366-369, and the CP1 is an interferon gamma;
the PM1 comprises a sequence selected from the group consisting of SEQ ID NOs: 370-374, and the CP1 is an IL-12;
the PM1 comprises a sequence selected from the group consisting of SEQ ID NOs: 375-382, 469-477, 478, and the CP1 is an IL-15;
the PM1 comprises a sequence selected from the group consisting of SEQ ID NOs: 383-468, 469-478, and the CP1 is an IL-2; or
the PM1 comprises a sequence selected from the group consisting of SEQ ID NOs: 478 and 479, and the CP1 is an IL-21.

8. The ACC of any one or combination of items 2-7, wherein:
the PM2 comprises a sequence selected from the group consisting of SEQ ID NOs: 328, 329, 323, and 331-369, and the CP2 is an interferon;
the PM2 comprises a sequence selected from the group consisting of SEQ ID NOs: 328, 329, 323, and 331-364, and the CP2 is an interferon alpha;
the PM2 comprises a sequence selected from the group consisting of SEQ ID NOs: 331-360, 362-364, and the CP2 is an interferon beta;
the PM2 comprises a sequence selected from the group consisting of SEQ ID NOs: 331-360, 366-369, and the CP2 is an interferon gamma;
the PM2 comprises a sequence selected from the group consisting of SEQ ID NOs: 370-374, and the CP2 is an IL-12;
the PM2 comprises a sequence selected from the group consisting of SEQ ID NOs: 375-382, 469-477, 478, and the CP2 is an IL-15;
the PM2 comprises a sequence selected from the group consisting of SEQ ID NOs: 383-468, 469-478, and the CP2 is an IL-2; or
the PM2 comprises a sequence selected from the group consisting of SEQ ID NOs: 478 and 479, and the CP2 is an IL-21.

9. The ACC of any one or combination of items 2-8, wherein PM1, PM2 or PM1 and PM2 comprises SEQ ID NO: 323.

10. The ACC of any one or combination of items 2-9, wherein PM1, PM2 or PM1 and PM2 comprises SEQ ID NO: 331.

11. The ACC of any one or combination of items 2-10, wherein PM1, PM2 or PM1 and PM2 comprises SEQ ID NO: 332.

12. The ACC of any one or combination of items 2-11, comprising a mask linking region between PM1 and CP1 that comprises 15, 16, 17, 18, 19, 20, 21, or 22 amino acids.

13. The ACC of any one or combination of items 2-12, comprising a mask linking region between PM2 and CP2 that comprises 15, 16, 17, 18, 19, 20, 21, or 22 amino acids.

14. The ACC of any one or combination of items 1 to 13, wherein the DD1 and the DD2 are a pair selected from the group consisting of: a pair of Fc domains; a sushi domain from an alpha chain of human IL-15 receptor (IL15Ra) and a soluble IL-15; barnase and barnstar; a PKA and an AKAP; adapter/docking tag modules based on mutated RNase I fragments; an epitope and sdAb; an epitope and scFv; and SNARE modules based on interactions of the proteins syntaxin, synaptotagmin, synaptobrevin, and SNAP25; an antigen-binding domain and an epitope.

15. The ACC of item 14, wherein the DD1 and the DD2 are a pair of Fc domains.

16. The ACC of item 15, wherein the pair of Fc domains is a pair of human Fc domains.

17. The ACC of item 16, wherein the human Fc domains are human IgG1 Fc domains, human IgG2 Fc domains, human IgG3 Fc domains, or human IgG4 Fc domains.

18. The ACC of item 17, wherein the human Fc domains are human IgG4 Fc domains.

19. The ACC of item 16, wherein the human Fc domains comprise a sequence that is at least 80% identical to SEQ ID NO: 3.

20. The ACC of item 19, wherein the human Fc domains comprise a sequence that is at least 90% identical to SEQ ID NO: 3.

21. The ACC of item 20, wherein the human Fc domains comprise SEQ ID NO: 3.

22. The ACC of item 14, wherein the DD1 and the DD2 comprise SEQ ID NOs: 318 and 319, respectively.

23. The ACC of any one or combination of items 1-21, wherein the DD1 and the DD2 are the same.

24. The ACC of item 14, wherein the DD1 comprises an antigen-binding domain and DD2 comprises a corresponding epitope.

25. The ACC of item 24, wherein the antigen-binding domain is an anti-His tag antigen-binding domain and wherein the DD2 comprises a His tag.

26. The ACC of item 24, wherein the antigen-binding domain is a single chain variable fragment (scFv).

27. The ACC of item 24, wherein the antigen-binding domain is a single domain antibody (sdAb).

28. The ACC of item 14, wherein at least one of the DD1 and the DD2 comprises a dimerization domain substituent selected from the group consisting of a non-polypeptide polymer and a small molecule.

29. The ACC of item 28, wherein the DD1 and the DD2 comprise non-polypeptide polymers covalently bound to each other.

30. The ACC of item 29, wherein the non-polypeptide polymer is a sulfur-containing polyethylene glycol, and wherein the DD1 and the DD2 are covalently bound to each other via one or more disulfide bonds.

31. The ACC of item 28, wherein at least one of the DD1 and the DD2 comprises a small molecule.

32. The ACC of item 31, wherein the small molecule is biotin.

33. The ACC of item 32, wherein DD1 comprises biotin and DD2 comprises an avidin.

34. The ACC of any one or combination of items 1-33, wherein the CP1 and the CP2 are mature cytokines.

35. The ACC of any one or combination of items 1-33, wherein the CP1 and the CP2 comprise a signal peptide.

36. The ACC of any one or combination of items 1-35, wherein the CP1 and the CP2 are the same.

37. The ACC of any one or combination of items 1-35, wherein the CP1 and the CP2 are different.

38. The ACC of any one or combination of items 1-35, wherein the CP1 and/or the CP2 is/are an interferon.

39. The ACC of item 38, wherein the CP1 and the CP2 are an interferon.

40. The ACC of item 38, wherein the CP1 and the CP2 are different interferons.

41. The ACC of item 38, wherein the CP1 and the CP2 are the same interferon.

42. The ACC of any one one or combination of items 38-41, wherein the interferon(s) is/are a human wildtype mature interferon.

43. The ACC of any one one or combination of items 38-42, wherein the interferon(s) is/are selected from the group consisting of: interferon-alpha, interferon-beta, interferon-omega, and interferon-tau.

44. The ACC of item 43, wherein the interferons is/are an interferon-alpha.

45. The ACC of item 44, wherein the interferon(s) is/are selected from the group consisting of: interferon alpha-2a, interferon alpha-2b, and interferon alpha-n3.

46. The ACC of item 45, wherein the interferon(s) is/are interferon alpha-2b.

47. The ACC of item 46, wherein the CP1 and/or the CP2 comprises a sequence that is at least 80% identical to SEQ ID NO: 1.

48. The ACC of item 47, wherein the CP1 and/or the CP2 comprises a sequence that is at least 90% identical to SEQ ID NO: 1.
49. The ACC of item 48, wherein the CP1 and/or the CP2 comprises the sequence of SEQ ID NO: 1.
50. The ACC of item 43, wherein the interferon is an interferon beta.
51. The ACC of item 50, wherein the interferon beta is selected from the group consisting of interferon beta-1a, and interferon beta-1b.
52. The ACC of any one or combination of items 1-51, wherein the CP1 and/or the CP2 comprises an IFab domain.
53. The ACC of any one or combination of items 1-38, wherein the CP1 and/or the CP2 comprises an interleukin.
54. The ACC of item 53, wherein the interleukin is selected from the group consisting of IL-1α, IL-1β, IL-1RA, IL-18, IL-2, IL-4, IL-7, IL-9, IL-13, IL-15, IL-3, IL-5, IL-6, IL-11, IL-12, IL-10, IL-20, IL-21, IL-14, IL-16, and IL-17.
55. The ACC of any one or combination of items 1-54, wherein each of the CM1 and the CM2 comprises a total of about 3 amino acids to about 15 amino acids.
56. The ACC of any one or combination of items 1-55, wherein one or more of the CM1, the CM2, the CM3, and the CM4 comprise substrates for different proteases.
57. The ACC of any one or combination of items 1-56, wherein the CM1, the CM2, and the CM3 comprise substrates for the same protease.
58. The ACC of any one or combination of items 1-57, wherein the protease(s) is/are selected from the group consisting of: ADAM8, ADAM9, ADAM10, ADAM12, ADAM15, ADAM17/TACE, ADAMDEC1, ADAMTS1, ADAMTS4, ADAMTS5, BACE, Renin, Cathepsin D, Cathepsin E, Caspase 1, Caspase 2, Caspase 3, Caspase 4, Caspase 5, Caspase 6, Caspase 7, Caspase 8, Caspase 9, Caspase 10, Caspase 14, Cathepsin B, Cathepsin C, Cathepsin K, Cathespin L, Cathepsin S, Cathepsin V/L2, Cathepsin X/Z/P, Cruzipain, Legumain, Otubain-2, KLK4, KLK5, KLK6, KLK7, KLK8, KLK10, KLK11, KLK13, KLK14, Meprin, Neprilysin, PSMA, BMP-1, MMP-1, MMP-2, MMP-3, MMP-7, MMP-9, MMP-10, MMP-11, MMP-12, MMP-13, MMP-14, MMP-15, MMP-16, MMP-17, MMP-19, MMP-20, MMP-23, MMP-24, MMP-26, MMP-27, activated protein C, cathepsin A, cathepsin G, Chymase, FVIIa, FIXa, FXa, FXIa, FXIIa, Elastase, Granzyme B, Guanidinobenzoatase, HtrA1, human neutrophil lyase, lactoferrin, marapsin, NS3/4A, PACE4, Plasmin, PSA, tPA, thrombin, tryptase, uPA, DESC1, DPP-4, FAP, Hepsin, Matriptase-2, MT-SP1/Matripase, TMPRSS2, TMPRSS3, and TMPRSS4.
59. The ACC of item 58, wherein the protease(s) is/are selected from the group consisting of: uPA, legumain, MT-SP1, ADAM17, BMP-1, TMPRSS3, TMPRSS4, MMP-2, MMP-9, MMP-12, MMP-13, and MMP-14.
60. The ACC of any one or combination of item 1-57, wherein the CM1, CM2, CM3, and/or the CM4 comprise a sequence selected from the group consisting of:

LSGRSDNH, (SEQ ID NO: 5)

TGRGPSWV, (SEQ ID NO: 6)

PLTGRSGG, (SEQ ID NO: 7)

TARGPSFK, (SEQ ID NO: 8)

NTLSGRSENHSG, (SEQ ID NO: 9)

NTLSGRSGNHGS, (SEQ ID NO: 10)

TSTSGRSANPRG, (SEQ ID NO: 11)

TSGRSANP, (SEQ ID NO: 12)

VHMPLGFLGP, (SEQ ID NO: 13)

AVGLLAPP, (SEQ ID NO: 14)

AQNLLGMV, (SEQ ID NO: 15)

QNQALRMA, (SEQ ID NO: 16)

LAAPLGLL, (SEQ ID NO: 17)

STFPFGMF, (SEQ ID NO: 18)

ISSGLLSS, (SEQ ID NO: 19)

PAGLWLDP, (SEQ ID NO: 20)

VAGRSMRP, (SEQ ID NO: 21)

VVPEGRRS, (SEQ ID NO: 22)

ILPRSPAF, (SEQ ID NO: 23)

MVLGRSLL, (SEQ ID NO: 24)

QGRAITFI, (SEQ ID NO: 25)

SPRSIMLA, (SEQ ID NO: 26)

SMLRSMPL, (SEQ ID NO: 27)

ISSGLLSGRSDNH, (SEQ ID NO: 28)

AVGLLAPPGGLSGRSDNH, (SEQ ID NO: 29)

ISSGLLSSGGSGGSLSGRSDNH, (SEQ ID NO: 30)

LSGRSGNH, (SEQ ID NO: 31)

SGRSANPRG, (SEQ ID NO: 32)

LSGRSDDH, (SEQ ID NO: 33)

-continued

LSGRSDIH, (SEQ ID NO: 34)

LSGRSDQH, (SEQ ID NO: 35)

LSGRSDTH, (SEQ ID NO: 36)

LSGRSDYH, (SEQ ID NO: 37)

LSGRSDNP, (SEQ ID NO: 38)

LSGRSANP, (SEQ ID NO: 39)

LSGRSANI, (SEQ ID NO: 40)

LSGRSDNI, (SEQ ID NO: 41)

MIAPVAYR, (SEQ ID NO: 42)

RPSPMWAY, (SEQ ID NO: 43)

WATPRPMR, (SEQ ID NO: 44)

FRLLDWQW, (SEQ ID NO: 45)

ISSGL, (SEQ ID NO: 46)

ISSGLLS, (SEQ ID NO: 47)

ISSGLL, (SEQ ID NO: 48)

ISSGLLSGRSANPRG, (SEQ ID NO: 49)

AVGLLAPPTSGRSANPRG, (SEQ ID NO: 50)

AVGLLAPPSGRSANPRG, (SEQ ID NO: 51)

ISSGLLSGRSDDH, (SEQ ID NO: 52)

ISSGLLSGRSDIH, (SEQ ID NO: 53)

ISSGLLSGRSDQH, (SEQ ID NO: 54)

ISSGLLSGRSDTH, (SEQ ID NO: 55)

ISSGLLSGRSDYH, (SEQ ID NO: 56)

ISSGLLSGRSDNP, (SEQ ID NO: 57)

ISSGLLSGRSANP, (SEQ ID NO: 58)

ISSGLLSGRSANI, (SEQ ID NO: 59)

AVGLLAPPGGLSGRSDDH, (SEQ ID NO: 60)

-continued

AVGLLAPPGGLSGRSDIH, (SEQ ID NO: 61)

AVGLLAPPGGLSGRSDQH, (SEQ ID NO: 62)

AVGLLAPPGGLSGRSDTH, (SEQ ID NO: 63)

AVGLLAPPGGLSGRSDYH, (SEQ ID NO: 64)

AVGLLAPPGGLSGRSDNP, (SEQ ID NO: 65)

AVGLLAPPGGLSGRSANP, (SEQ ID NO: 66)

AVGLLAPPGGLSGRSANI, (SEQ ID NO: 67)

ISSGLLSGRSDNI, (SEQ ID NO: 68)

AVGLLAPPGGLSGRSDNI, (SEQ ID NO: 69)

GLSGRSDNHGGAVGLLAPP, (SEQ ID NO: 70)

GLSGRSDNHGGVHMPLGFLGP, (SEQ ID NO: 71)

LSGRSDNHGGVHMPLGFLGP, (SEQ ID NO: 72)

ISSGLSS, (SEQ ID NO: 73)

PVGYTSSL, (SEQ ID NO: 74)

DWLYWPGI, (SEQ ID NO: 75)

LKAAPRWA, (SEQ ID NO: 76)

GPSHLVLT, (SEQ ID NO: 77)

LPGGLSPW, (SEQ ID NO: 78)

MGLFSEAG, (SEQ ID NO: 79)

SPLPLRVP, (SEQ ID NO: 80)

RMHLRSLG, (SEQ ID NO: 81)

LLAPSHRA, (SEQ ID NO: 82)

GPRSFGL, (SEQ ID NO: 83)

GPRSFG, (SEQ ID NO: 84)

SARGPSRW, (SEQ ID NO: 85)

GGWHTGRN, (SEQ ID NO: 86)

HTGRSGAL, (SEQ ID NO: 87)

-continued

AARGPAIH, (SEQ ID NO: 88)

RGPAFNPM, (SEQ ID NO: 89)

SSRGPAYL, (SEQ ID NO: 90)

RGPATPIEVI, (SEQ ID NO: 91)

RGPA, (SEQ ID NO: 92)

GGQPSGMWGW, (SEQ ID NO: 93)

FPRPLGITGL, (SEQ ID NO: 94)

SPLTGRSG, (SEQ ID NO: 95)

SAGFSLPA, (SEQ ID NO: 96)

LAPLGLQRR, (SEQ ID NO: 97)

SGGPLGVR, (SEQ ID NO: 98)

PLGL, (SEQ ID NO: 99)
and

SGRSDNI. (SEQ ID NO: 100)

61. The ACC of item 60, wherein the CM1, the CM2, the CM3 and/or the CM4 comprises a sequence selected from the group consisting of: ISSGLLSGRSDNH (SEQ ID NO: 28), LSGRSDDH (SEQ ID NO: 33), ISSGLLSGRSDQH (SEQ ID NO: 54), SGRSDNI (SEQ ID NO: 100), and ISSGLLSGRSDNI (SEQ ID NO: 68).

62. The ACC of any one or combination of items 1-61, wherein the protease(s) is/are produced by a tumor in a subject.

63. The ACC of item 62, wherein the subject has been diagnosed or identified as having a cancer.

64. The ACC of any one or combination of items 1-63, wherein the CP1 and the CM1 directly abut each other in the first monomer construct.

65. The ACC of any one or combination of items 1-64, wherein the CM1 and the DD1 directly abut each other in the first monomer construct.

66. The ACC of any one or combination of items 1-65, wherein the CP2 and the CM2 directly abut each other in the second monomer construct.

67. The ACC of any one or combination of items 1-66, wherein the CM2 and the DD2 directly abut each other in the second monomer construct.

68. The ACC of any one or combination of items 1-63, wherein the first monomer construct comprises at least one linker.

69. The ACC of item 68, wherein the at least one linker is a linker L1 disposed between the PM1 and the CM3 and/or a linker L2 disposed between the CM3 and the CP1.

70. The ACC of item 68, wherein the second monomer construct comprises at least one linker.

71. The ACC of item 70, wherein the at least one linker is a linker L3 disposed between the PM2 and the CM4 and/or a linker L4 disposed between the CM4 and the CP2.

72. The ACC of item 71, wherein the first monomer construct comprises a linker L1 and the second monomer construct comprises a linker L3.

73. The ACC of item 72, wherein L1 and L3 are the same.

74. The ACC of item 71, wherein the first monomer construct comprises a linker L2 and the second monomer construct comprises a linker L4.

75. The ACC of item 74, wherein L2 and L4 are the same.

76. The ACC of any one or combination of items 68-75, wherein each linker has a total length of 1 amino acid to about 15 amino acids.

77. The ACC of item 76, wherein each linker has a total length of at least 5 amino acids.

78. The ACC of item 68, wherein the first monomer construct comprises at least one linker, wherein each linker is independently selected from the group consisting of GSSGGSGGSGG (SEQ ID NO: 210); GGGS (SEQ ID NO: 2); GGGSGGGS (SEQ ID NO: 211); GGGSGGGSGGGS (SEQ ID NO: 212); GGGGSGGGGSGGGGS (SEQ ID NO: 213); GGGGSGGGGSGGGGSGGGGSGGGGS (SEQ ID NO: 214); GGGGSGGGGS (SEQ ID NO: 215); GGGGS (SEQ ID NO: 216); GS; GGGGSGS (SEQ ID NO: 217); GGGGSGGGGSGGGGSGS (SEQ ID NO: 218); GGSLDPKGGGGS (SEQ ID NO: 219); PKSCDKTHTCPPCPAPELLG (SEQ ID NO: 220); SKYGPPCPPCPAPEFLG (SEQ ID NO: 221); GKSSGSGSESKS (SEQ ID NO: 222); GSTSGSGKSSEGKG (SEQ ID NO: 223); GSTSGSGKSSEGSGSTKG (SEQ ID NO: 224); GSTSGSGKPGSGEGSTKG (SEQ ID NO: 225); GSTSGSGKPGSSEGST (SEQ ID NO: 226); (GS)n, (GGS)n, (GSGGS)n (SEQ ID NO: 227), (GGGS)n (SEQ ID NO: 228), (GGGGS)n (SEQ ID NO: 216), wherein each n is an integer of at least one; GGSG (SEQ ID NO: 229); GGSGG (SEQ ID NO: 230); GSGSG (SEQ ID NO: 231; GSGGG (SEQ ID NO: 232); GGGSG (SEQ ID NO: 233); GSSSG (SEQ ID NO: 234); GGGGSGGGGSGGGGS (SEQ ID NO: 213); GGGGSGGGGSGGGGSGGGGS (SEQ ID NO: 214); GSTSGSGKPGSSEGST (SEQ ID NO: 226); SGGG (SEQ ID NO: 327); and SGGGG (SEQ ID NO: 492).

79. The ACC of item 78, wherein the linker comprises a sequence of GGGS (SEQ ID NO: 2).

80. The ACC of any one or combination of items 1-79, wherein the first monomer construct comprises in a N- to C-terminal direction, the PM1, the CM3, the CP1, the CM1, and the DD1.

81. The ACC of any one or combination of items 1-79, wherein the first polypeptide comprises in a C- to N-terminal direction, the PM1, the CM3, the CP1, the CM1, and the DD1.

82. The ACC of any one or combination of items 1-81, wherein the second polypeptide comprises in a N- to C-terminal direction, the CP2, CM2, and the DD2.

83. The ACC of any one or combination of items 1-82, wherein the second polypeptide comprises in a C- to N-terminal direction, the CP2, CM2, and the DD2.

84. The ACC of any one or combination of items 1-36, 38, 39, or 41-83, wherein the first monomer construct and the second monomer construct are the same.

85. The ACC of any one or combination of items 1-79, wherein the first monomer construct comprises in a N- to C-terminal direction, the PM1, an optional linker, the CM3, an optional linker, the CP1, the CM1, and the DD1, wherein the CP1 and the CM1 directly abut each other, wherein the CM1 and the DD1 directly abut each other, wherein the CM1 is a peptide of not more than 10 amino acids, wherein the second monomer construct is the same as the first monomer construct, and wherein the first and second monomer constructs are covalently bound to each other via at least two disulfide bonds.

86. The ACC of item 85, wherein the DD1 and the DD2 are each a human Fc domain having an N-terminus at Cysteine 216, as numbered according to EU numbering.
87. The ACC of item 85 or 86, wherein the CM1 is a peptide of not more than 7 amino acids.
88. The ACC of any one or combination of item 85-87, wherein the CP1 and the CP2 comprise an amino acid sequence that is at least 90% identical to SEQ ID NO: 1.
89. The ACC of any one or combination of items 1-88, wherein the ACC is characterized by having a reduced level of at least one CP1 and/or CP2 activity as compared to a control level of at least one CP1 and/or CP2 activity.
90. The ACC of item 89, wherein the at least one of the CP1 and the CP2 activity is a level of proliferation of lymphoma cells.
91. The ACC of item 89, wherein the at least one of the CP1 and the CP2 activity is the level of JAK/STAT/ISGF3 pathway activation in a lymphoma cell.
92. The ACC of item 89, wherein the at least one activity is a level of SEAP production in a lymphoma cell.
93. The ACC of item 89, wherein the ACC is characterized by at least a 2-fold reduction in at least one of the CP1 and the CP2 activity as compared to the control level.
94. The ACC of item 93, wherein the ACC is characterized by at least a 5-fold reduction in at least one CP1 and/or the CP2 activity as compared to the control level.
95. The ACC of item 94, wherein the ACC is characterized by at least a 10-fold reduction in at least one activity of the CP1 and/or the CP2 as compared to the control level.
96. The ACC of item 95, wherein the ACC is characterized by at least a 500-fold reduction in at least one CP1 and/or the CP2 activity as compared to the control level.
97. The ACC of any one or combination of items 89-95, wherein the control level of the at least one activity of the CP1 and/or the CP2, is the activity of the CP1 and/or the CP2 in the ACC following exposure of the ACC to the protease(s).
98. The ACC of any one or combination of items 89-97, wherein the control level of the at least one CP1 and/or CP2, is the corresponding CP1 and/or the CP2 activity of a corresponding wildtype mature cytokine.
99. The ACC of any one or combination of items 89-98, wherein the ACC is characterized by generating a cleavage product following exposure to the protease(s), wherein the cleavage product comprises the at least one activity of the CP1 and/or the CP2.
100. The ACC of item 99, wherein the at least one activity of the CP1 and/or the CP2 is anti-proliferation activity.
101. The ACC of item 100, wherein the control level is an EC50 value, and wherein ratio of EC50 (cleavage product) to EC50 (control level) is less than about 10, or less than about 9, or less than about 8, or less than about 7, or less than about 6, or less than about 5, or less than about 4, or less than about 3, or less than about 2, or less than about 1.5, or less than about 1.0.
102. The ACC of any one or combination of items 1-101, wherein the first monomer construct is characterized in that the CP1 and the DD1 are linked by a linking region of no more than 18 amino acids such that the linking region of no more than 18 amino acids includes the CM3.
103. The ACC of any one or combination of items 1-102, wherein the second monomer construct is characterized in that the CP2 and the DD2 are linked by a linking region of no more than 18 amino acids such that the linking region of no more than 18 amino acids includes the CM2.
104. The ACC of any one or combination of items 1-103, wherein the PM1 comprises less than 50 amino acids.
105. The ACC of any one or combination of items 2-104, wherein the PM2 comprises less than 50 amino acids.
106. The ACC of item 105, wherein each of PM1 and PM2 is less than 19 amino acids.
107. The ACC of any one or combination of items 1-103, wherein the PM1 is not a latency associated peptide and the PM2 is not a latency associated peptide.
108. The ACC of any one or combination of items 1-103, wherein the PM1 is not a receptor for a cytokine and the PM2 is not a receptor for a cytokine and/or does not have an amino acid sequence that is at least 85% identical to a receptor for a cytokine.
109. The ACC of any one or combination of items 1-103, wherein the PM1 is not a fragment of a receptor for a cytokine and/or does not have an amino acid sequence that is at least 85% identical to a receptor for a cytokine.
110. The ACC of any one or combination of items 1-103 and 109, wherein the PM2 is not a fragment of a receptor for a cytokine.
111. The ACC of any one or combination of items 1-103, wherein the PM1 is not an albumin and the PM2 is not an albumin.
112. A composition comprising an ACC of any one or a combination of items 1-111.
113. The composition of item 112, wherein the composition is a pharmaceutical composition.
114. A container, vial, syringe, injector pen, or kit comprising at least one dose of the composition of item 112 or 113.
115. A method of treating a subject in need thereof comprising administering to the subject a therapeutically effective amount of the ACC of any one of items 1-96 or the composition of items 112 or 113.
116. The method of item 115, wherein the subject has been identified or diagnosed as having a cancer.
117. The method of item 116, wherein the cancer is a lymphoma.
118. The method of item 117, wherein the lymphoma is Burkitt's lymphoma.
119. A nucleic acid encoding a polypeptide that comprises the CP1 and the CM1 of the ACC of any one or a combination of items 1-111.
120. The nucleic acid of item 109, wherein the polypeptide further comprises the DD1 of any one or combination of items 1-21 or items 28-111.
121. A nucleic acid encoding a polypeptide that comprises the CP2 and the CM2 of the ACC of any one or combination of items 1-111.
122. The nucleic acid of item 111, wherein the polypeptide further comprises the DD2 of any one or combination of items 1-21 or items 28-111.
123. A vector comprising the nucleic acid of any one or a combination of items 119-122.
124. The vector of item 123, wherein the vector is an expression vector.
125. A cell comprising the nucleic acid of any one or a combination of items 119-122 or the vector of item 123 or 124.

126. A pair of nucleic acids that together encode a polypeptide that comprises the CP1 and the CM1 of the first monomer construct and a polypeptide that comprises the CP2 and the CM2 of the second monomer construct of any one or combination of items 1-111.

127. A pair of vectors that together comprise the pair of nucleic acids of item 126.

128. The pair of vectors of item 127, wherein the pair of vectors is a pair of expression vectors.

129. A cell comprising the pair of nucleic acids of item 126 or the pair of vectors of items 127 or 128.

130. A method of producing an ACC comprising:
a. culturing a cell of item 125 or 129 in a liquid culture medium under conditions sufficient to produce the ACC; and
b. recovering the ACC from the cell or the liquid culture medium.

131. The method of item 130, further comprising: isolating the ACC recovered from the cell or the liquid culture medium.

132. The method of item 131, further comprising: formulating isolated ACC into a pharmaceutical composition.

133. An ACC produced by the method of item 130.

134. A composition comprising an ACC of item 133.

135. The composition of item 134, wherein the composition is a pharmaceutical composition.

136. A container, vial, syringe, injector pen, or kit comprising at least one dose of the composition of item 134 or 135.

137. The ACC of any one or combination of items 89-101, wherein the at least one of the CP1 and the CP2 activity is a binding affinity of the CP1 and/or the CP2 for its cognate receptor as determined using surface plasmon resonance.

138. An activatable cytokine construct (ACC) comprising a first monomer construct and a second monomer construct, wherein:
(a) the first monomer construct is a polypeptide comprising a first peptide mask (PM1), a first mature cytokine protein (CP1), a first and a third cleavable moieties (CM1 and CM3), and a first dimerization domain (DD1);
(b) the second monomer construct is a polypeptide comprising a second peptide mask (PM2), a second mature cytokine protein (CP2), a second and a fourth cleavable moieties (CM2 and CM4), and a second dimerization domain (DD2);
(c) the first monomer construct comprises, in an N- to C-terminal direction, the PM1, the CM3, the CP1, the CM1, and the DD1, further wherein:
(i) the PM1 comprises no more than 20 amino acids and binds to the CP1,
(ii) the CM1 and the DD1 directly abut each other,
(iii) the CP1 and the CM1 directly abut each other,
(iv) the CM1 comprises no more than 12 amino acids,
(v) the CM1 and the CM3 each functions as a substrate for a protease, and
(vi) the CP1 is a mature interferon;
(d) further wherein:
(i) the second monomer construct is the same as the first monomer construct,
(ii) the DD1 and the DD2 are a pair of human IgG Fc domains;
(iii) the DD1 and the DD2 bind to each other via at least one disulfide bond, thereby forming a homodimer of the first monomer construct and the second monomer construct; and
(e) the ACC is characterized by having a reduced level of interferon activity as compared to a corresponding wildtype interferon or a corresponding pegylated interferon.

139. The ACC of item 138, wherein the CP1 is a mature interferon-alpha and the PM1 comprises a sequence that is at least 85% identical to SEQ ID NO: 323.

140. The ACC of item 138 or 139, wherein the CM1 and the CM3 each independently functions as a substrate of urokinase (uPa) and/or a matrix metalloproteinase (MMP).

141. The ACC of item 140, wherein the CM1 and the CM3 each independently functions as a substrate of urokinase (uPa) and/or MMP-14.

142. The ACC of any one or combination of items 138-141, wherein the mature interferon is a mature human interferon alpha.

143. The ACC of any one or combination of items 138-142, wherein the mature interferon alpha is mature interferon alpha-2b.

144. The ACC of any one or combination of items 138-143, wherein the mature interferon alpha is a truncated form of a wildtype mature interferon alpha-2b.

145. The ACC of any one or combination of items 138-144, wherein the mature interferon comprises a sequence that is at least 95% identical to SEQ ID NO: 1.

146. The ACC of any one or combination of items 138-145, wherein the mature interferon comprises the sequence of SEQ ID NO: 1.

147. The ACC of any one or combination of items 138-146, wherein the CM1 and the CM3 each comprises no more than 8 amino acids.

148. The ACC of any one or combination of items 138-147, wherein the CM1 and the CM3 are the same.

149. The ACC of any one or combination of items 138-148, wherein the CM1 and the CM3 each comprises a sequence that is at least 85% identical to SEQ ID NO: 41.

150. The ACC of any one or combination of items 138-148, wherein the CM1 and the CM3 each comprises a sequence selected from the group consisting of SEQ ID NO: 41, SEQ ID NO: 68, and SEQ ID NO: 100.

151. The ACC of any one or combination of items 138-150, wherein the DD1 and the DD2 are a pair of human IgG4 Fc domains.

152. The ACC of item 151, wherein the DD1 and the DD2 are a pair of human IgG4 Fc domains truncated at N-terminus to Cysteine 226 as numbered by EU numbering.

153. The ACC of item 151 or 152, wherein the human IgG4 Fc domains comprise a S228P mutation as numbered by EU numbering.

154. The ACC of any one or combination of items 138-153, wherein the DD1 and the DD2 each comprises a sequence that is at least 95% identical to SEQ ID NO: 3.

155. The ACC of any one or combination of items 138-154, wherein the DD1 and the DD2 each comprises the sequence of SEQ ID NO: 3.

156. The ACC of any one or combination of items 138-155, wherein the first and second monomer constructs are covalently bound to each other via at least two disulfide bonds.

157. The ACC of item 156, wherein the first and second monomer constructs are covalently bound to each other via at least three disulfide bonds.

158. The ACC of any one or combination of items 138-157, wherein:
the first monomer construct further comprises a first signal sequence at the N-terminus, and the second monomer construct further comprises a second signal sequence at the N-terminus.
159. The ACC of item 158, wherein the first and second signal sequences each comprises a sequence that is at least 95% identical to SEQ ID NO: 244.
160. The ACC of item 159, wherein the first and second signal sequences each comprises the sequence of SEQ ID NO: 244.
161. The ACC of any one or combination of items 158-160, wherein:
the first monomer construct further comprises a first spacer positioned between the first signal sequence and the PM1, and the second monomer construct further comprises a second spacer positioned between the second signal sequence and the PM2.
162. The ACC of item 161, wherein the first and second spacers each comprises a sequence that is at least 80% identical to SEQ ID NO: 256.
163. The ACC of item 162, wherein the first and second spacers each comprises a sequence of SEQ ID NO: 256.
164. The ACC of any one or combination of items 138-163, further comprising a linker L1 between the PM1 and the CM3, and/or a linker L2 between the CM3 and the CP1, wherein each of L1 and L2 independently comprises a sequence that is at least 80% identical to SEQ ID NO: 27 (wherein n=1), a sequence that is at least 80% identical to SEQ ID NO: 324, or is absent.
165. The ACC of item 164, wherein the L1 comprises the sequence SEQ ID NO: 27 (wherein n=1) and L2 comprises the sequence of SEQ ID NO: 324.
166. The ACC of any one or combination of items 138-165 comprising a linking region comprising no more than 12 amino acids.
167. The ACC of item 166, wherein the linking region comprises 7 to 12 amino acids.
168. The ACC of item 166, wherein the linking region comprises 7 amino acids.
169. The ACC of any one or combination of items 138-168, wherein the ACC is characterized by at least a 2000-fold reduction in interferon alpha activity as compared to wildtype interferon alpha.
170. The ACC of item 169, wherein the ACC is characterized by at least a 4000-fold reduction in interferon alpha activity as compared to wildtype interferon alpha.
171. The ACC of item 170, wherein the ACC is characterized by at least a 5000-fold reduction in interferon alpha activity as compared to wildtype interferon alpha.
172. The ACC of any one or combination of items 138-168, wherein the ACC is characterized by at least a 2000-fold reduction in interferon alpha activity as compared to pegylated interferon alpha.
173. The ACC of any one or combination of items 138-172, wherein the reduction in interferon activity is determined by comparing the EC50 of the ACC with the EC50 of the wildtype interferon or the pegylated interferon in an anti-proliferation assay in lymphoma cells.
174. The ACC of any one or combination of items 138-173, wherein the reduction in interferon activity is determined by comparing the EC50 of the ACC with the EC50 of the wildtype interferon or the pegylated interferon in an assay of induction of secreted embryonic alkaline phosphatase production in interferon-responsive HEK293 cells.
175. The ACC of any of items 138-174, wherein the ACC is further characterized by generating a cleavage product following exposure to the protease(s) for which CM1 and CM3 function as a substrate, wherein the ratio of the interferon activity of the corresponding wildtype interferon to the cleavage product is less than about 2.
176. The ACC of item 175, wherein the EC50 of the cleavage product is approximately the same as the EC50 of the corresponding wildtype interferon.
177. The ACC of item 138, wherein the first and second monomer constructs each comprises a sequence that is at least 95% identical to SEQ ID NO: 321 or wherein each of the first and second monomer constructs comprises the sequence of SEQ ID NO: 321 or is identical to SEQ ID NO: 321, wherein the ACC is characterized by at least a 1000-fold reduction in interferon activity as compared to wildtype interferon alpha-2b, and wherein the ACC is further characterized by generating a cleavage product following exposure to uPA, wherein the cleavage product has approximately the same interferon activity as wildtype interferon alpha-2b, wherein interferon activity is measured in an anti-proliferation assay in lymphoma cells or in an assay of induction of secreted embryonic alkaline phosphatase production in interferon-responsive HEK293 cells.
178. An activatable cytokine construct (ACC) comprising a first monomer construct and a second monomer construct, wherein:
(a) the first monomer construct comprises a first peptide mask (PM1), a first mature cytokine protein (CP1), a first and a third cleavable moieties (CM1 and CM3), and a first dimerization domain (DD1);
(b) the second monomer construct is a polypeptide comprising a second peptide mask (PM2), a second mature cytokine protein (CP2), a second and a fourth cleavable moieties (CM2 and CM4), and a second dimerization domain (DD2);
(c) the first monomer construct is a polypeptide comprising, in an N- to C-terminal direction, the PM1, the CM3, the CP1, the CM1, and the DD1, further wherein:
  (i) the PM1 comprises a sequence that is at least 85% identical to SEQ ID NO: 323,
  (ii) the CM1 and the DD1 directly abut each other,
  (iii) the CM1 comprises a sequence that is at least 85% identical to SEQ ID NO: 41, and
  (iv) the CP1 comprises a sequence that is at least 85% identical to SEQ ID NO: 1;
(d) further wherein:
  (i) the second monomer construct is the same as the first monomer construct,
  (ii) the DD1 and DD2 are a pair of human IgG4 Fc domains;
(e) the DD1 and the DD2 covalently bind to each other via at least one disulfide bond, thereby forming a homodimer of the first monomer construct and the second monomer construct; and
(f) the ACC is characterized by having a reduced level of interferon alpha activity as compared to the interferon alpha activity of PEGylated interferon alpha-2b.
179. The ACC of item 178, wherein the PM2 comprises a sequence that is at least 85%, 90%, or 95% identical to one of SEQ ID NOs: 323, 331, or 332.
180. The ACC of item 138, wherein the first and second monomer constructs each comprises a sequence that is at least 95% identical to SEQ ID NO: 321 or wherein each of the first and second monomer constructs comprises the sequence of SEQ ID NO: 321 or is identical to SEQ ID NO: 321, wherein the ACC exhibits lower toxicity in vivo compared to either wildtype interferon alpha-2b or PEGylated interferon alpha-2b.

181. A composition comprising the ACC of any one or combination of items 138-180.

182. The composition of item 181, where the composition is a pharmaceutical composition.

183. A container, vial, syringe, injector pen, or kit comprising at least one dose of the composition of item 181 or 182.

184. A method of treating a subject in need thereof comprising administering to the subject a therapeutically effective amount of the ACC of any one or combination of items 138-179 or the composition of item 181 or 182.

185. The method of item 184, wherein the subject has been identified or diagnosed as having a cancer.

186. A nucleic acid encoding a polypeptide that comprises the first monomer of the ACC of any one or combination of items 138-179.

187. A vector comprising the nucleic acid of item 186.

188. The vector of item 187, wherein the vector is an expression vector.

189. A mammalian cell comprising the nucleic acid of item 186 or the vector of item 187 or 188.

190. The mammalian cell of item 189, wherein the mammalian cell is an HEK293 cell or a CHO cell.

191. A method of manufacturing an ACC, the method comprising:
expressing the ACC in the mammalian cell of item 189 or 190; and
purifying the expressed ACC.

192. The ACC of any one or combination of items 138-180, wherein the CM1 and the CM3 each functions as a substrate for a protease that is over-expressed in a tumor tissue.

193. The ACC of any one or combination of any preceding items, wherein PM1, PM2 or PM1 and PM2 comprises SEQ ID NO: 323.

194. The ACC of any one or combination of any preceding items, wherein PM1, PM2 or PM1 and PM2 comprises SEQ ID NO: 331.

195. The ACC of any one or combination of any preceding items, wherein PM1, PM2 or PM1 and PM2 comprises SEQ ID NO: 332.

196. The ACC of any one or combination of any preceding items, wherein the CP1 and the DD1 are linked by a linking region of no more than 15 amino acids such that the linking region of no more than 15 amino acids includes the CM3.

197. The ACC of any one or combination of any preceding items, wherein the second monomer construct is characterized in that the CP2 and the DD2 are linked by a linking region of no more than 15 amino acids such that the linking region of no more than 15 amino acids includes the CM2.

198. The ACC of any one or combination of any preceding items, wherein the PM1, the PM2, or the PM1 and the PM2 are not a latency associated peptide.

199. The ACC of any one or combination of any preceding items, wherein the PM1, the PM2, or the PM1 and the PM2 are not a cytokine.

200. The ACC of any one or combination of any preceding items, wherein the PM1, the PM2, or the PM1 and the PM2 are not a receptor for a cytokine and/or do not have an amino acid sequence that is at least 85% identical to a receptor for a cytokine.

201. The ACC of any one or combination of any preceding items, wherein the PM1, the PM2, or the PM1 and the PM2 are not a fragment of a receptor for a cytokine.

202. The ACC of any one or combination of any preceding items, wherein the PM1, the PM2, or the PM1 and the PM2 are not an albumin.

203. The ACC of any one or combination of any preceding items, wherein the PM1, the PM2, or the PM1 and the PM2 are less than 50, 45, 40, 35, 30, 25, 20, 15, or 10 amino acids.

204. The ACC of any one or combination of the preceding items, wherein the ACC is characterized in that it has at least one of the following characteristics:
(i) a structural arrangement in an N- to C-terminal direction comprising: PM1-CM3-CP1-CM1-DD1 and CP2-CM2-DD2, wherein DD1 and DD2 are dimerized;
(ii) a structural arrangement in an N- to C-terminal direction comprising: PM1-CM3-CP1-CM1-DD1 and PM2-CM4-CP2-CM2-DD2, wherein DD1 and DD2 are dimerized;
(iii) wherein each of PM1 and PM2 is less than 40 amino acids;
(iv) wherein each of PM1 and PM2 is not a receptor for the CP1 and the CP2;
(v) wherein each of PM1 and PM2 does not have an amino acid sequence that is at least 85% identical to a receptor for a cytokine;
(vi) wherein each of PM1 and PM2 is not a fragment of receptor for the CP1 and the CP2;
(vii) wherein each of PM1 and PM2 is between 13 and 49 amino acids;
(viii) wherein the first monomer construct is characterized in that the CP1 and the DD1 are linked by a linking region of no more than 18 amino acids such that the linking region of no more than 18 amino acids includes the CM3;
(ix) when the ACC has an orientation of N-PM-CM1-CP-CM2-DD-C, then the entire span of amino acids from the N-terminus of the ACC to the N-terminal amino acid of the cytokine is 17 to 71 amino acids in length, and when the ACC has an orientation of N-DD-CM1-CP-CM2-PM-C, then the entire span of amino acids from the C-terminus of the ACC to the C-terminal amino acid of the cytokine is 17 to 71 amino acids in length; and/or
(x) wherein the second monomer construct is characterized in that the CP2 and the DD2 are linked by a linking region of no more than 18 amino acids such that the linking region of no more than 18 amino acids includes the CM2.

205. The ACC of any one or combination of any preceding items, wherein the first monomer construct has only one peptide mask.

206. The ACC of any one or combination of any preceding items, wherein the second monomer construct has only one peptide mask.

207. The ACC of any one or combination of any preceding items, wherein the first monomer construct has only one peptide mask and the second monomer construct has only one peptide mask.

208. A method of attenuating IP-10 release in a subject in need thereof comprising administering the ACC of any one or combination of any preceding items.

EXAMPLES

The invention is further described in the following examples, which do not limit the scope of the invention described in the claims.

Example 1: In Vitro Characterization of Example Cytokine Constructs

An activatable cytokine construct ProC440 was prepared by recombinant methods. The 1st and 2nd monomer constructs of the ProC440 were identical, with each being a polypeptide having the amino acid sequence of SEQ ID NO: 316 and a signal sequence at its N-terminus. Each of the 1st and 2nd monomer constructs comprises, from N-terminus to C-terminus, a signal sequence (e.g., SEQ ID NO: 244), a mature cytokine protein that corresponds to human interferon alpha-2b (SEQ ID NO: 1), a cleavable moiety having the amino acid sequence of SEQ ID NO: 100, and a dimerization domain corresponding to human IgG4 Fc, truncated at Cys226 (according to EU numbering) and including an S228P mutation (SEQ ID NO: 3).

The polypeptide was prepared by transforming a host cell with a polynucleotide having the sequence of SEQ ID NO: 316, followed by cultivation of the resulting recombinant host cells. Dimerization of the resulting expressed polypeptides yielded the cytokine construct ProC440.

The activity of ProC440 was tested in vitro using IFN-responsive HEK293 cells and Daudi cells. See FIGS. 7A and 7B, respectively.

IFN-responsive HEK293 cells were generated by stable transfection with the human STAT2 and IRF9 genes to obtain a fully active type I IFN signaling pathway. The cells also feature an inducible SEAP (secreted embryonic alkaline phosphatase) reporter gene under the control of the IFNα/β inducible ISG54 promoter. To maintain transgene expression, cells were cultured in DMEM GlutaMax media supplemented with 10% FBS, Pen/Strep, 30 μg/mL of blasticidin, 100 μg/ml of zeocin and 100 μg/mL of normocin. The addition of type I IFN to these cells activates the JAK/STAT/ISGF3 pathway and subsequently induces the production of SEAP which can be readily assessed in the supernatant using Quanti-Blue solution, a colorimetric detection for alkaline phosphatase activity.

The Daudi cell is a cell line of human B-cell lymphoblastic origin. Daudi cells were prepared at a concentration of 2×105 cells/mL in RPMI-1640 media supplemented with 10% FBS and 50 μL aliquots were pipetted into wells of a white flat-bottom 96-well plate (10K/well). The tested ProC440 or controls were diluted in RPMI 1640 media supplemented with 10% FBS. Duplicate five-fold serial dilutions were generated from which 50 μL was added to the each well. After 3 days of incubation at 37° C., a viability kit was used to measure the levels of intracellular ATP as an indirect estimate of the number of viable cells remaining. 100 μL of cell-titer go was directly added to the plates which were then placed on an orbital shaker for 10 minutes. Following this incubation, the luminescent signal was directly measured using an Envision plate reader. Dose-response curves were generated and EC50 values were obtained by sigmoidal fit non-linear regression using Graph Pad Prism software.

Figure 7A:
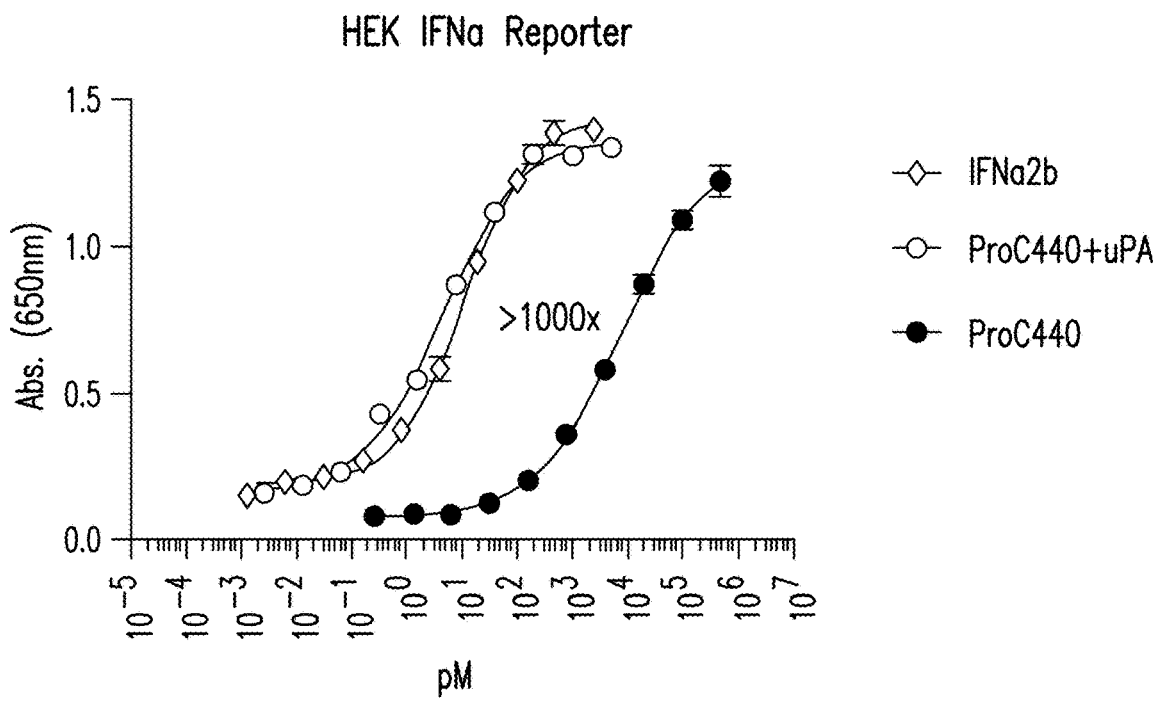
FIGS. 7A-7B show the activity of a cytokine construct (ProC440) tested in vitro using IFN-responsive HEK293 cells (FIG. 7A) and Daudi cells (FIG. 7B).
Figure 7B:
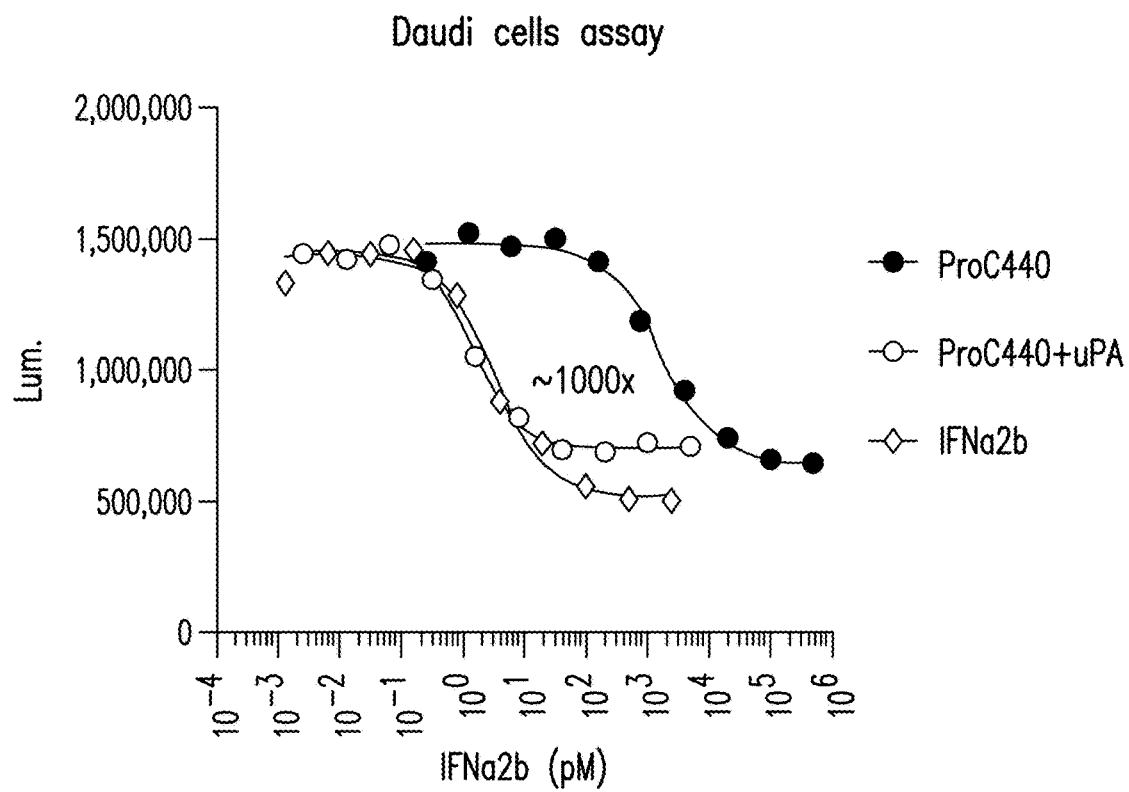

In both of the assays using HEK293 cells and Daudi cells, the activity of ProC440 was reduced at least 1,000× as compared to Stem Cell IFNα-2b (human recombinant IFN-alpha2b, available from StemCell Technologies, Catalog #78077.1) (FIGS. 7A and 7B). This indicates that the fusion of a cleavable dimerization domain corresponding to human IgG Fc provided steric masking to IFNα-2b in the ProC440 construct. Protease activation with uPa restored activity to a level comparable to the recombinant cytokine. EC50 values for ProC440, ProC440+uPA, and Stem Cell IFNα-2b were computed from the IFNα/β assay results and are provided below in Table 3.

TABLE 3

| | EC50: IFNα/β Reporter Assay | | |
| --- | --- | --- | --- |
| | ProC440 | ProC440 + uPA | Stem Cell IFNα-2b |
| EC50 | 7643 | 4.333 | 10.88 |

EC50 values for ProC440, ProC440+uPA, and Stem Cell IFNα-2b were computed from the Daudi apoptosis assay results and are provided below in Table 4.

TABLE 4

| | EC50: Daudi Apoptosis Assay | | |
| --- | --- | --- | --- |
| | ProC440 | ProC440 + uPA | Stem Cell IFNα-2b |
| EC50 | 264.2 | 0.1842 | 0.3530 |

Figure 6C:
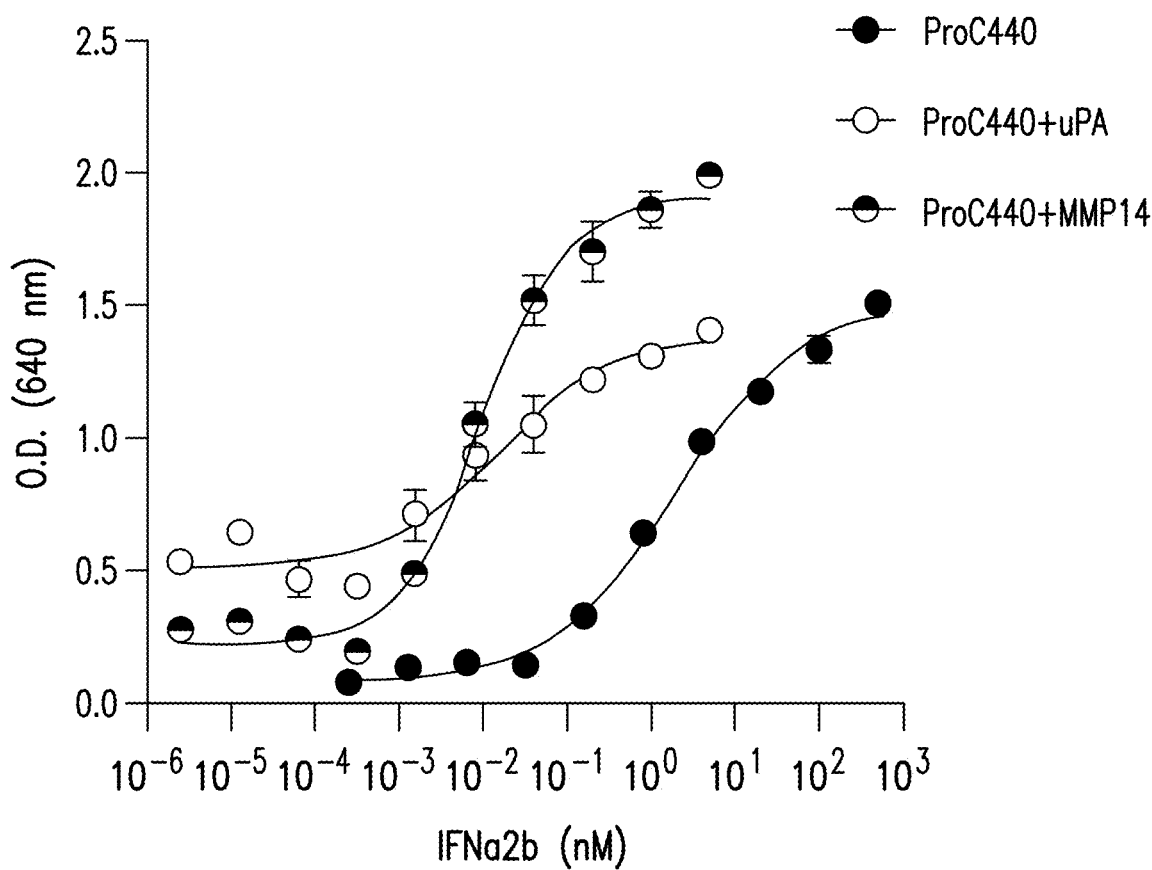

Cleavage with uPa at the expected site in the cleavable moiety was confirmed by electrophoresis and Mass spectrometry analysis (FIGS. 6A and 6B). The results suggest that the uPa protease was effective at cleaving the cleavable moieties in the ProC440 activatable cytokine construct. In addition to sensitivity to uPa activation, ProC440 was cleaved by MMP14 (FIGS. 6A to 6C). FIG. 6A depicts the gel electrophoresis results; the left column shows ProC440 that has not been exposed to protease, the middle column shows ProC440 exposed to protease uPA, and the far right column shows ProC440 exposed to MMP14. Analysis by Mass spectrometry identified an MMP14 cleavage site at the C-terminal extremity of IFNα-2b, near the cleavable moiety (FIG. 6B). Protease activation with MMP14 also restored activity to a level comparable to the recombinant cytokine (FIG. 6C). The data indicate that ProC440 recovered full activity after cleavage of intrinsic and engineered cleavable moieties by proteases such as uPa or MMP14.

Activatable cytokine construct ProC732 was prepared by recombinant methods. The $1^{st}$ and $2^{nd}$ monomer constructs of this ACC were identical, with each being a polypeptide having the amino acid sequence shown in FIG. 8 (SEQ ID NO: 321 with an exemplary optional signal sequence). Each of the $1^{st}$ and $2^{nd}$ monomer constructs comprises, from N-terminus to C-terminus, a signal sequence, a spacer (QSGQ) sequence, an IFNα-2b masking peptide (SEQ ID NO: 323), a linker (SEQ ID NO:324), a cleavable moiety having the amino acid sequence of SEQ ID NO: 41 (LSGRSDNI), a linker (SEQ ID NO: 227, wherein n=1), a mature cytokine protein that corresponds to human interferon alpha-2b (SEQ ID NO:1), a cleavable moiety having the amino acid sequence of SEQ ID NO: 41, and a DD corresponding to human IgG4 S228P Fc, truncated to Cys226 (according to EU numbering) (SEQ ID NO:3).

Another activatable cytokine construct, ProC733, was prepared by recombinant methods. The $1^{st}$ and $2^{nd}$ monomer constructs of this ACC were identical, with each being a polypeptide having the amino acid sequence shown in FIG. 9 (SEQ ID NO: 322 with an exemplary optional signal sequence). Each of the $1^{st}$ and $2^{nd}$ monomer constructs comprises, from N-terminus to C-terminus, a signal sequence, a spacer (e.g., QSGQ) sequence, an IFNα-2b masking peptide (SEQ ID NO: 323), a linker (SEQ ID NO: 324), a cleavable moiety having the amino acid sequence of SEQ ID NO: 41, a linker (SEQ ID NO: 227, wherein n=1), a mature cytokine protein that corresponds to human interferon alpha-2b (SEQ ID NO:1), and a DD corresponding to human IgG4 S228P Fc, including the full hinge sequence (SEQ ID NO: 4). Because the ProC733 construct lacks a cleavable moiety between the cytokine sequence and the DD, it is only partially activatable, as discussed below.

The masked cytokine constructs ProC732 and ProC733 were prepared by transforming a host cell with polynucleotides encoding the sequence of SEQ ID NOs: 321 and 322, respectively, followed by cultivation of the resulting recombinant host cells. Dimerization of the resulting expressed polypeptides yielded the cytokine constructs ProC732 and ProC733, respectively.

Figure 10A:
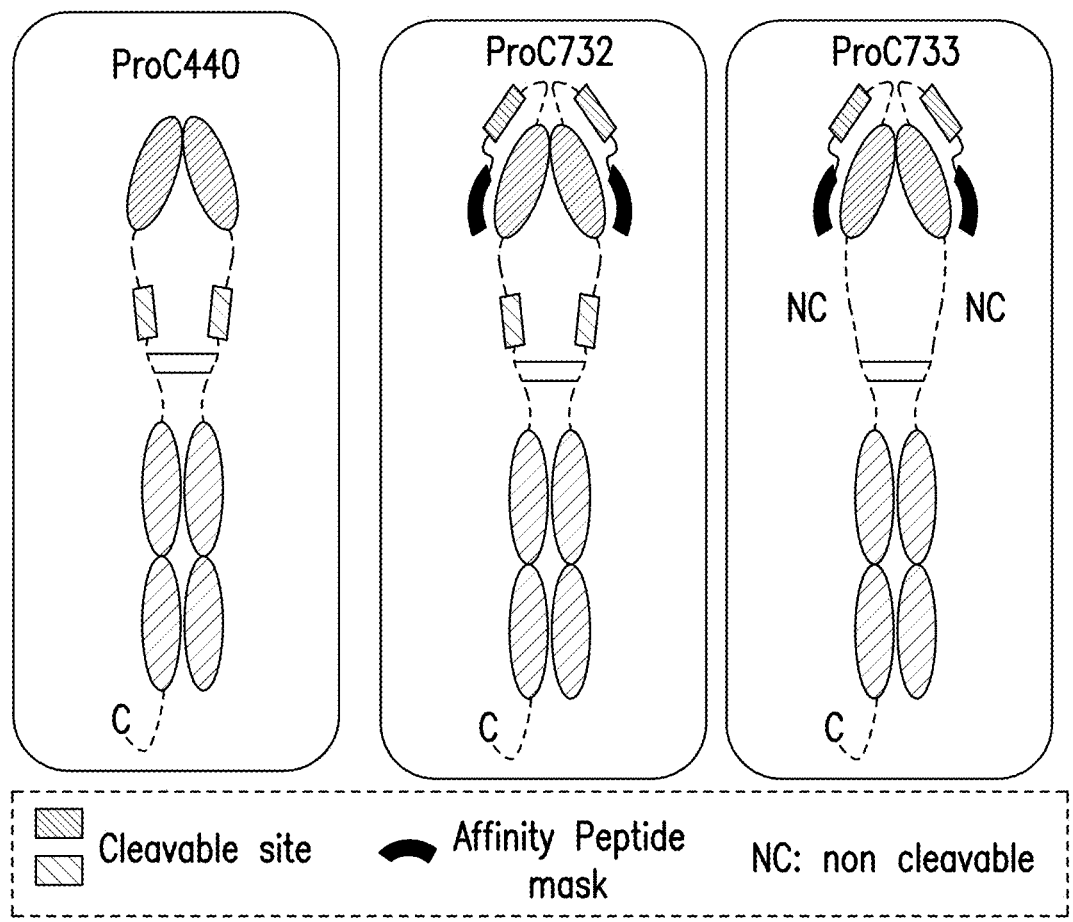
FIG. 10A shows schematics of cytokine constructs ProC440, ProC732 and ProC733.
Figure 10B:
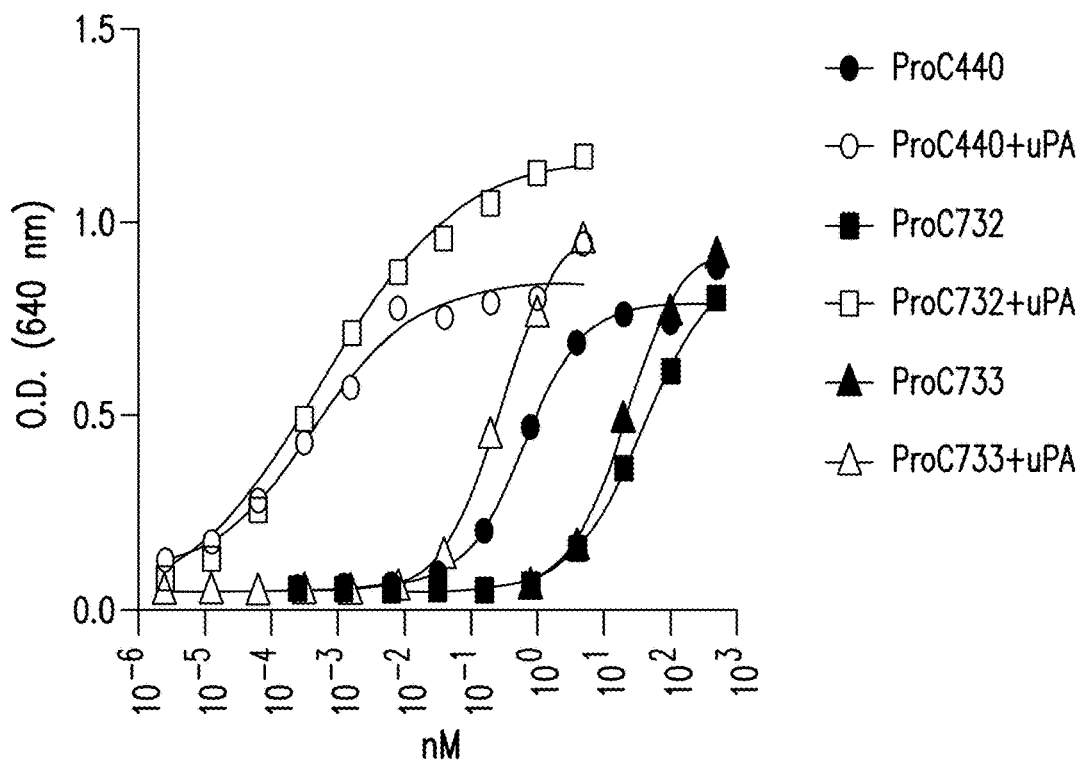
FIG. 10B shows the activity of cytokine constructs (ProC440, ProC732 and ProC733) tested using IFN-responsive HEK293 cells.
Figure 10C:
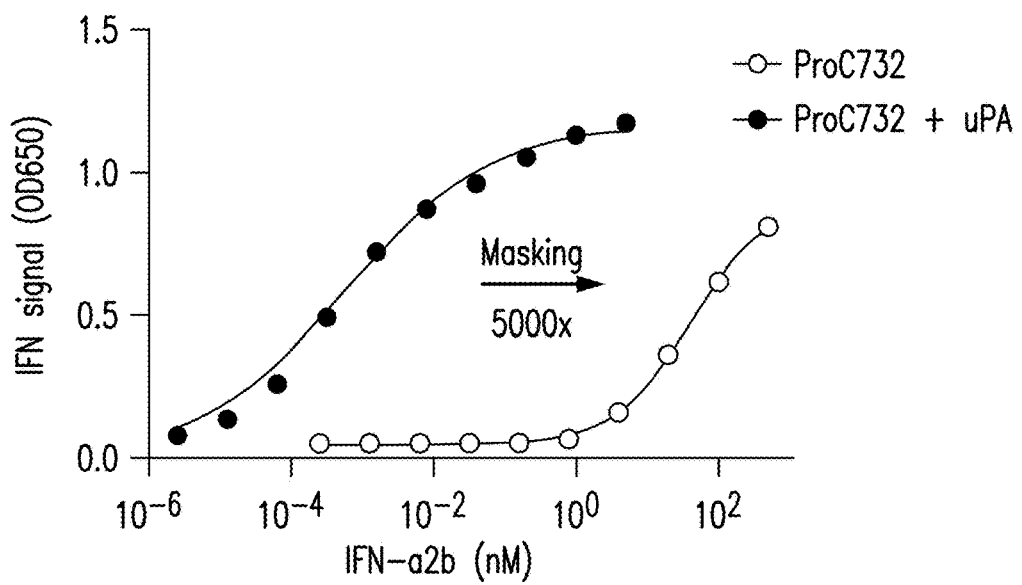
FIG. 10C shows the activity of cytokine construct ProC732 (also referred to as Pb-IFNalpha-2b), tested using IFN-responsive HEK293 cells.

The activity of ProC732, ProC733 and ProC440 was tested in vitro using IFN-responsive HEK293 cells as previously described. The activity of ProC732 and ProC733 was further reduced as compared to ProC440 (FIGS. 10A-10C). This indicates that the addition of a peptide mask provided additional masking strength even though the cytokine activity was already significantly reduced in ProC440 by steric masking through the dimerization domains. Surprisingly, it appears that the addition of a masking peptide (PM) does not interfere with steric masking by the DD, nor does the DD appear to interfere with masking by the PM. Protease activation with uPa restored the activity of ProC732 to a level comparable to the level of ProC440 after protease activation with uPa. This indicates that ProC732, upon protease activation, recovered the full strength of activity of an unmasked IFNα-2b.

ProC733 contains an affinity peptide mask attached to IFNalpha-2b via a cleavable moiety, with the C-terminus of IFNα-2b fused directly to human IgG Fc (without a cleavable moiety interposed between the cytokine and the Fc region). Protease activation with uPa restored the activity of ProC733 to a level comparable to the level of unactivated ProC440. This further indicates that in addition to the steric masking provided by the cleavable human IgG Fc, or constraint by IFNα-2b dimerization, a cleavable affinity peptide mask provides additional masking strength to IFNα-2b. EC50 values for ProC440, ProC440+uPA, ProC732, ProC732+uPA, ProC733, and ProC733+uPA were computed from the IFNα/β assay results and are provided below in Table 5.

The masking efficiencies of ACCs in a HEK reporter assay (as measured by comparing the EC50 of the uncleaved ACC to the EC50 of the cleaved ACC) were as follows:
ProC440: 1358X
ProC732: 7380X
ProC733: 60X Thus, high levels of masking efficiency (e.g., >5,000×) can be achieved in ACCs that include both a peptide mask and steric masking through dimerization domains as shown, for example, in FIG. 10C.

Figure 31:
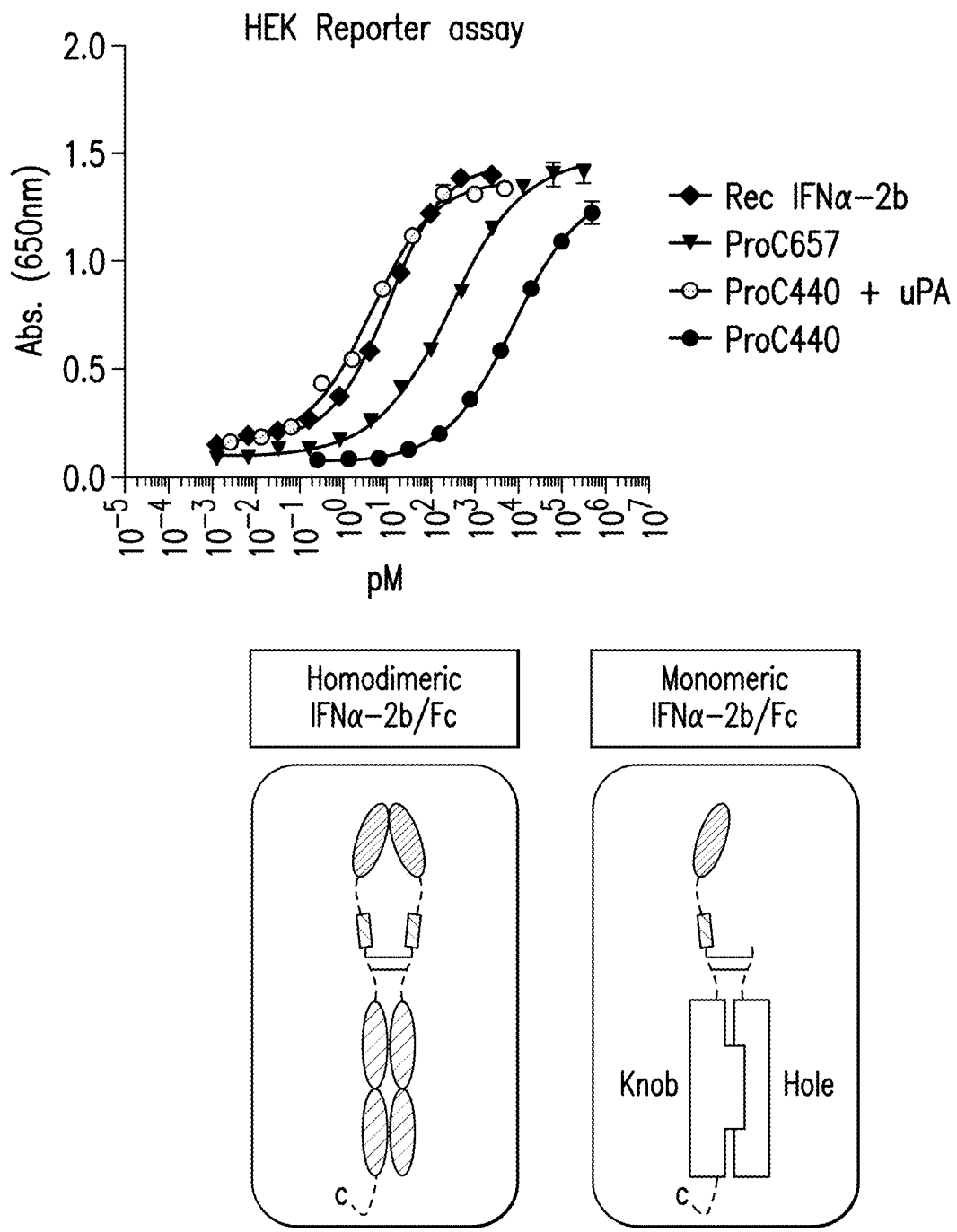
FIG. 31 shows activity of recombinant IFNa2b, monomeric IFNa2b (ProC657), activated homodimeric IFNa2b (ProC440+uPA), and homodimeric IFNa2b (ProC440) using IFN-responsive HEK293.
Figure 42A:
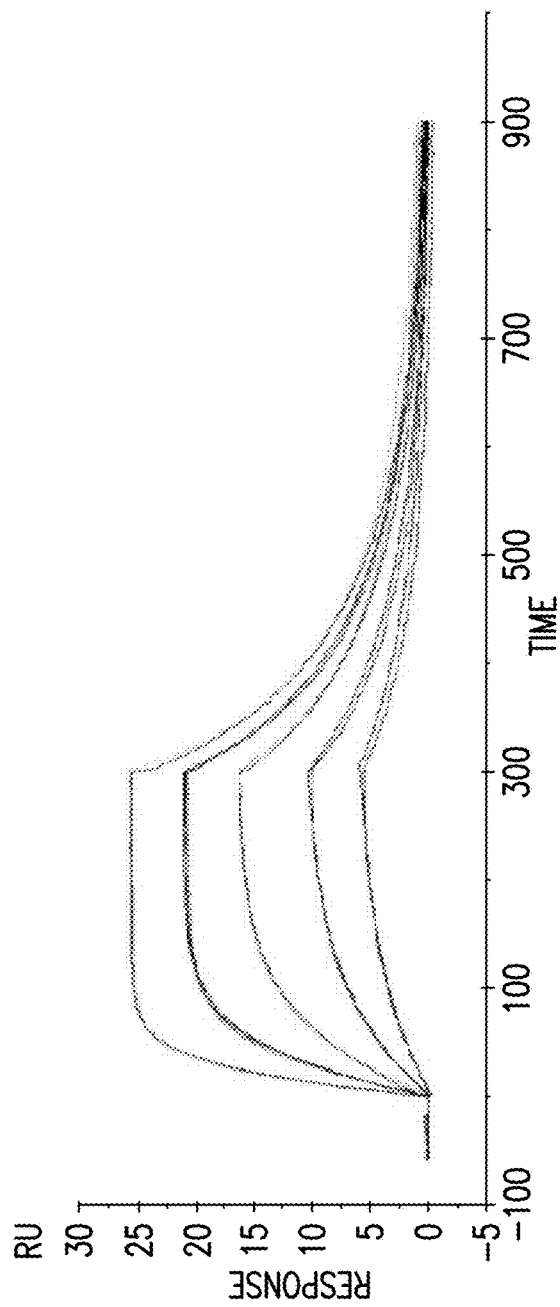
FIGS. 42A-42D show binding of single masked Pb-IFN-a2b molecules to human IFNAR2. The ligands were captured on a chip coated with immobilized anti-human Fc (FIGS. 42A-42B) or anti-histidine antibodies (FIGS. 42C-42D). Concentrations of IFN-a2b (ProC1640) ranging from 25 nM to 1.5625 µM were flowed over the ligand-captured chip to generate multi-cycle kinetic sensorgrams (FIGS. 42A and 42C). Masked Pb-IFN-a2b molecules (ProC440—FIG. 42D, ProC1976—FIG. 42B) at concentrations ranging from 250 nM to 15.625 µM were flowed over the ligand-captured chip to generate multi-cycle kinetic sensorgrams.
Figure 42B:
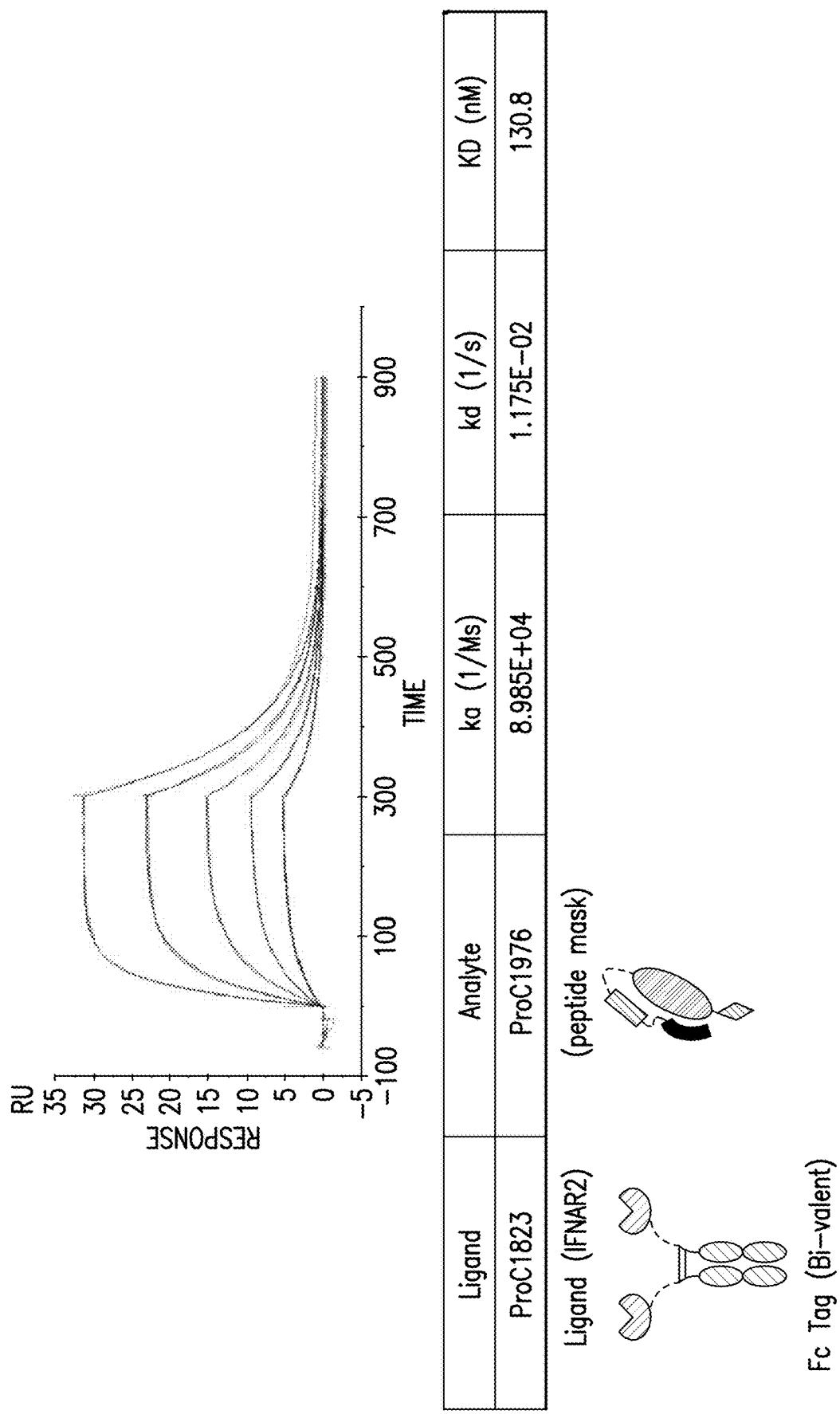
Figure 42C:
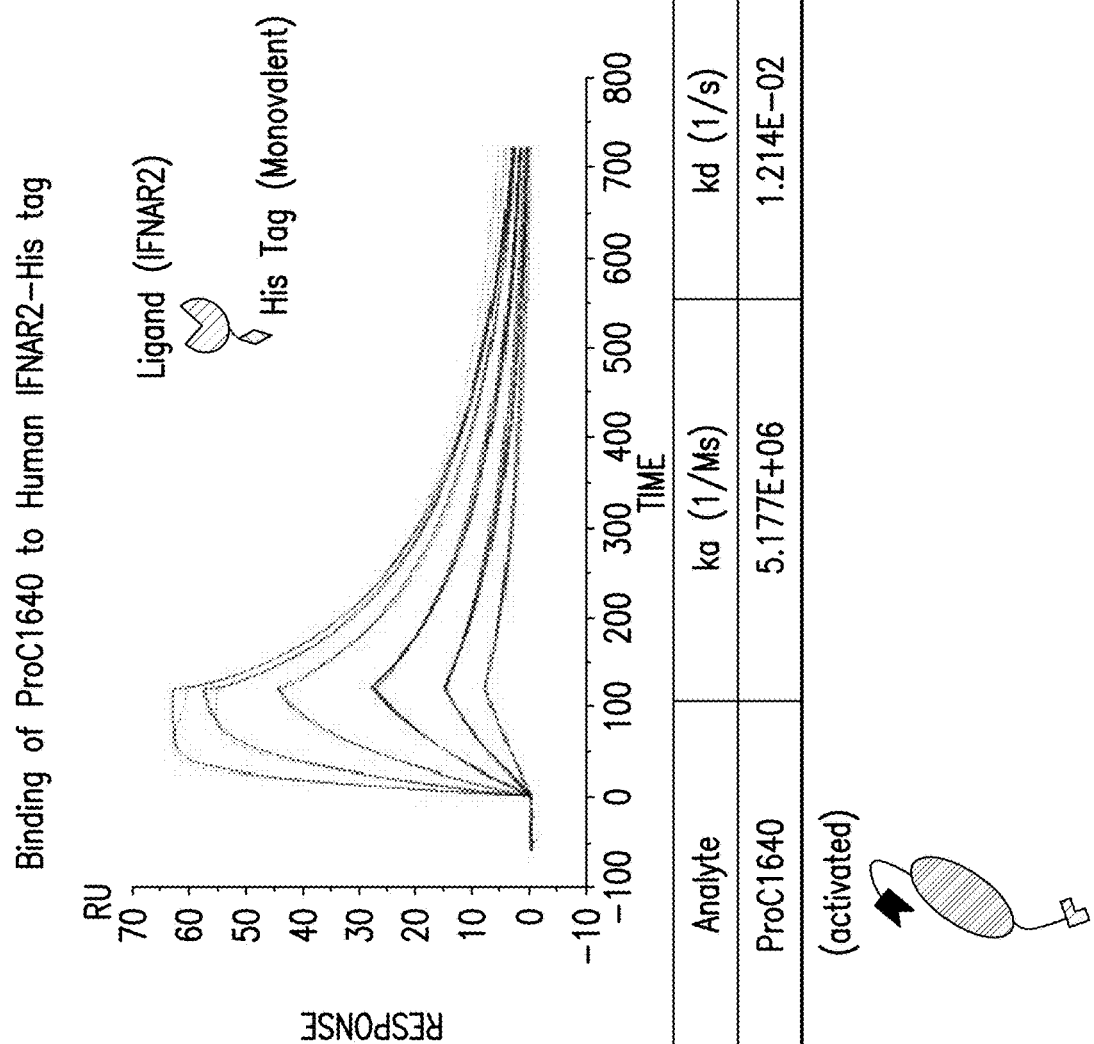
Figure 42D:
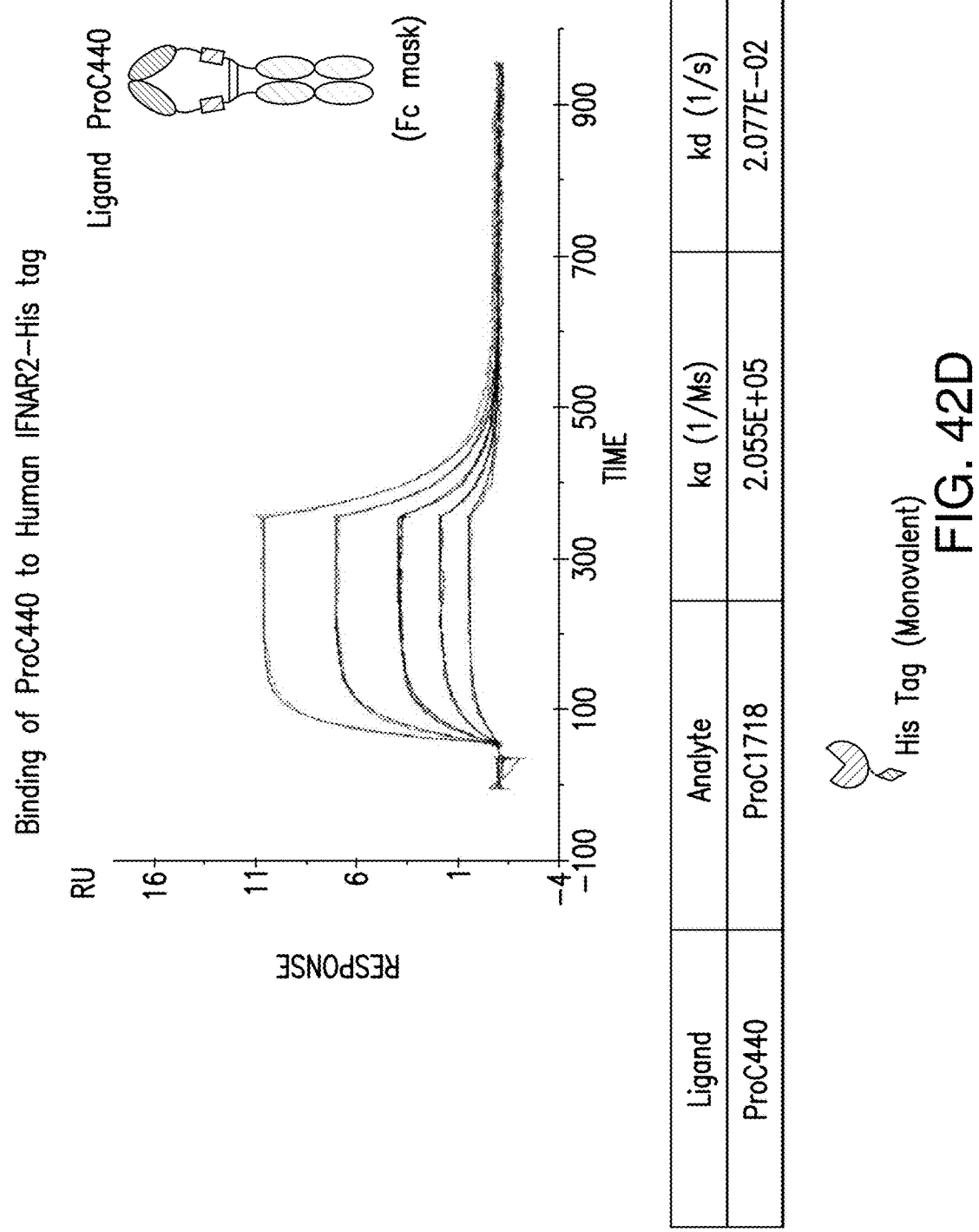

As shown in FIGS. 42A-42D, each of the peptide masks (FIG. 42A (no peptide mask) vs. FIG. 42B (peptide masked)) and the Fc masks (FIG. 42C (no Fc mask) vs. 42D (Fc masked)) affect binding of the ACC to the receptor. In view of the data, synergistic activity has been obtained through the use of the dual masking structure of the ACCs of the present disclosure. The activity of recombinant IFNa2b, monomeric IFNa2b/Fc, activated homodimeric IFNa2b/Fc, and homodimeric IFNa2b/Fc was tested in vitro using IFN-responsive HEK293 cells as previously described. Recombinant IFNa2b, monomeric IFNa2b/Fc, activated homodimeric IFNa2b/Fc, and homodimeric IFNa2b/Fc were prepared as described above. The activity of homodimeric IFNa2b/Fc was substantially reduced compared to recombinant IFNa2b, but was rescued by protease activation to a level commensurate with recombinant IFNa2b (FIG. 31). FIG. 31 also shows that monomeric IFNa2b/Fc exhibited activity at an approximate midpoint between the activity observed for activated and unactivated homodimeric IFNa2b/Fc.

Figure 35A:
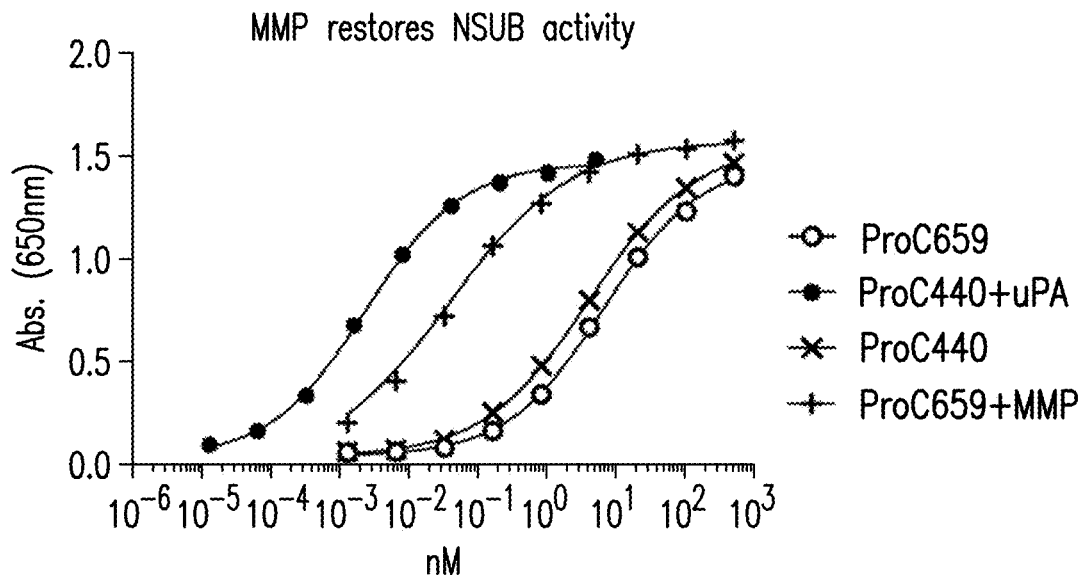
FIG. 35A shows MMP restores NSUB (ProC649) activity.
Figure 35B:
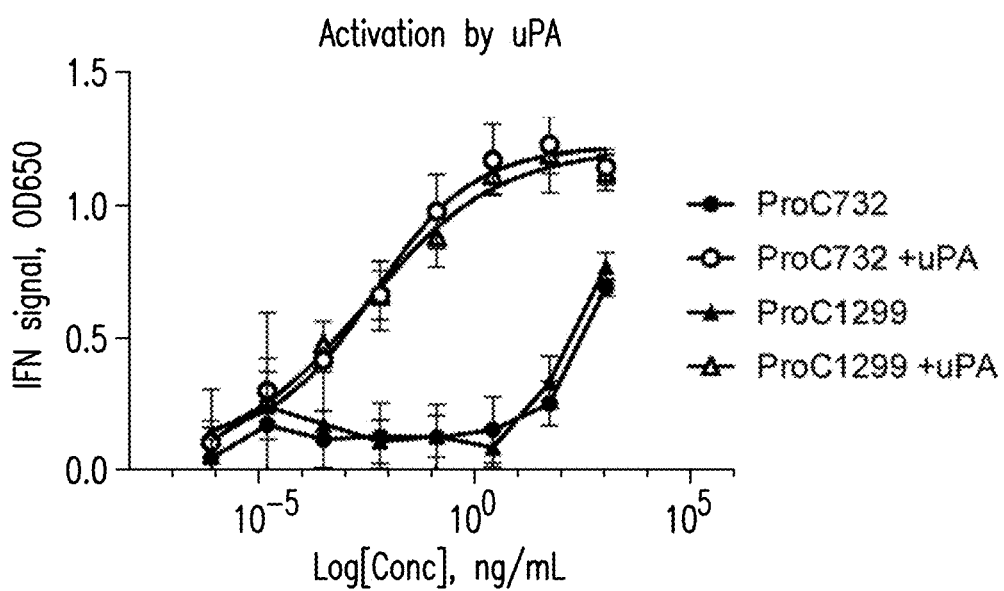
FIG. 35B shows conditional activation of ProC732 and ProC1299 by uPA.

Additionally, ProC440 shows substantially reduced activity compared to uPA treated ProC440 (FIG. 35A). The same molecule, but with a NSUB substrate has restored activity in response to MMP indicating the presence of a cryptic cleavage site (FIG. 35A). The activity of both ProC732 and ProC1299 (deletion of L161) was rescued by uPA (FIG. 35B). Deletion of L161 (in the MMP14 cleavage site) prevents activation of ProC1301 (NSUB substrate) even in the presence of MMP14 or uPA (FIG. 35C).

Example 2: In Vivo Tolerability of Cytokine Constructs

Human IFNα-2b cross-reacts with hamster IFNα receptor and has been previously shown to be active in hamster (Altrock et al, Journal of Interferon Research, 1986). To assess the tolerability of IFNα-2b-containing cytokine constructs, Syrian Gold Hamsters were dosed with a starting dose of 0.4 mg/kg. Animals received one dose of test article and kept on study up to 7 days post dose, unless non-tolerated toxicities were identified. The starting dose (0.4 mpk) represents an equivalent dose of IFNα-con (recombinant interferon alpha, a non-naturally occurring type-I interferon manufactured by Amgen under the name Infergen®) expected to induce body weight lost, decreased food con-

TABLE 5

| | | EC50: IFNα/β Reporter Assay | | | | |
|---|---|---|---|---|---|---|
| | ProC440 | ProC440 + uPA | ProC732 | ProC732 + uPA | ProC733 | ProC733 + uPA |
| EC50 | 0.6344 | 0.0004 | 40.69 | 0.0005 | 21.83 | 0.2977 | sumption and bone marrow suppression in a hamster (125 gr). If the starting dose was tolerated, animals were moved up to a "medium dose" of 2 mg/kg and received three doses of test article unless not tolerated. If tolerated, animals were moved up to a "high dose" of 10 mg/kg and received three doses of test article unless not tolerated. If tolerated, animals were moved up to a "higher dose" of 15 mg/kg. At each stage, if the test dose was not tolerated, the animal was moved down to the next lower dose. If the starting dose was not tolerated, the animal was moved down to a "lower dose" of 0.08 mg/kg. Animals were also dosed with the unmasked IFNα-2b Fc fusion constructs ProC286. As a negative control, animals were dosed with a human IgG4.

ProC286 (ChIgG4 5AA 1204DNIdL IFNa2b) was also prepared by recombinant methods. The $1^{st}$ and $2^{nd}$ monomer constructs were identical, with each being a polypeptide having the amino acid sequence of SEQ ID NO: 326 and a signal sequence at its N-terminus. Each of the $1^{st}$ and $2^{nd}$ monomer constructs comprises, from N-terminus to C-terminus, a signal sequence, a DD corresponding to human IgG4 S228P Fc including the ESKYGPP (SEQ ID NO: 317) hinge sequence (SEQ ID NO:4), a linker (SEQ ID NO:327), a cleavable moiety having the amino acid sequence of SEQ ID NO:100, a linker (SEQ ID NO: 228), and a mature cytokine protein that corresponds to human interferon alpha-2b (SEQ ID NO:1).

ProC291 (NhIgG4 5AA 1204DNIdL IFNa2b) was also prepared by recombinant methods. The $1^{st}$ and $2^{nd}$ monomer constructs were identical, with each being a polypeptide having the amino acid sequence of SEQ ID NO: 496 and a signal sequence at its N-terminus. Each of the $1^{st}$ and $2^{nd}$ monomer constructs comprises, from N-terminus to C-terminus, a signal sequence, a mature cytokine protein that corresponds to human interferon alpha-2b (SEQ ID NO: 1), a linker (SEQ ID NO: 492), a CM (SEQ ID NO: 100), a linker (GGGS), and a human IgG4 Fc region including the ESKYGPP (SEQ ID NO: 317) hinge sequence (SEQ ID NO: 4).

The activity of ProC286 and ProC291 were compared to the activity of Sylatron® (PEG-IFN-alpha2b) in the Daudi apoptosis assay (FIGS. 11A-11B). In this assay, ProC286 and Sylatron® show similar levels of activity as shown in FIG. 11A. This indicates that ProC286 has similar activity to commercially-available pegylated IFN-alpha2b, and could be used as surrogate Sylatron control to evaluate the tolerability of IFNα-2b in the hamster study. ProC291 showed reduced activity compared to ProC286 and Sylatron®, indicating that the structural orientation of the IFN N-terminal to the Fc was important for reduction in activity. That is, when the DD is a pair of Fc domains, positioning the cytokine N-terminal to the DD (as in ProC291) may provide greater reduction of cytokine activity than when the cytokine is positioned C-terminal to the DD (as in ProC286).

Figure 13A:
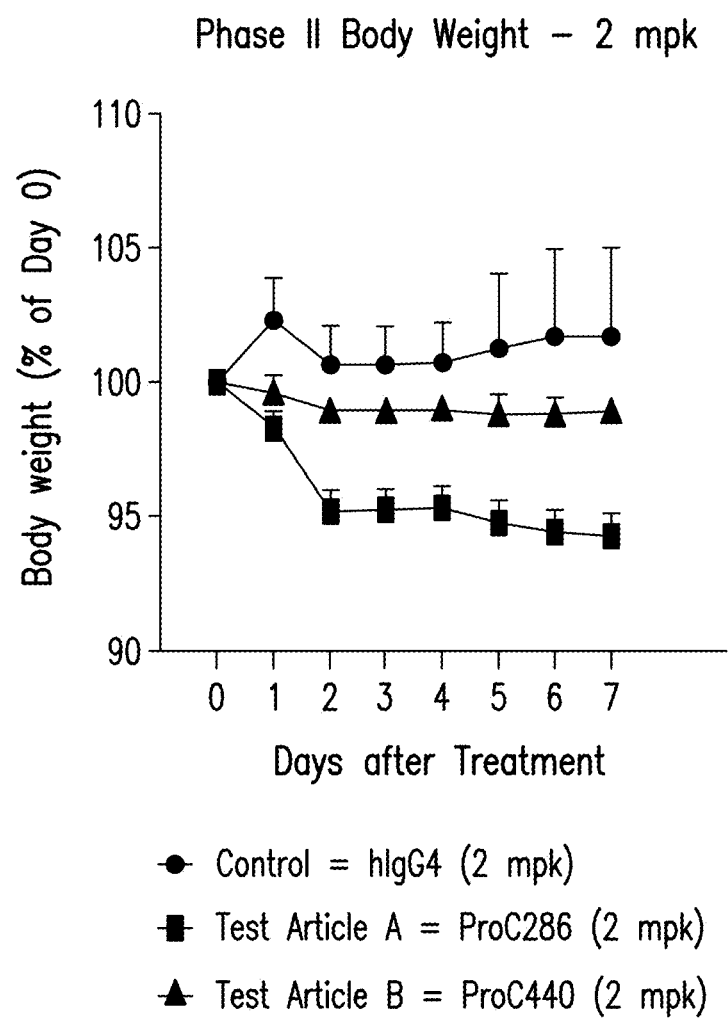
FIGS. 13A-13C show body weight loss profiles of animals in response to different doses of cytokine constructs ProC286, ProC440, and ProC732 or control (human IgG4) in tolerability tests at different dosages in Syrian Gold Hamsters.
Figure 13B:
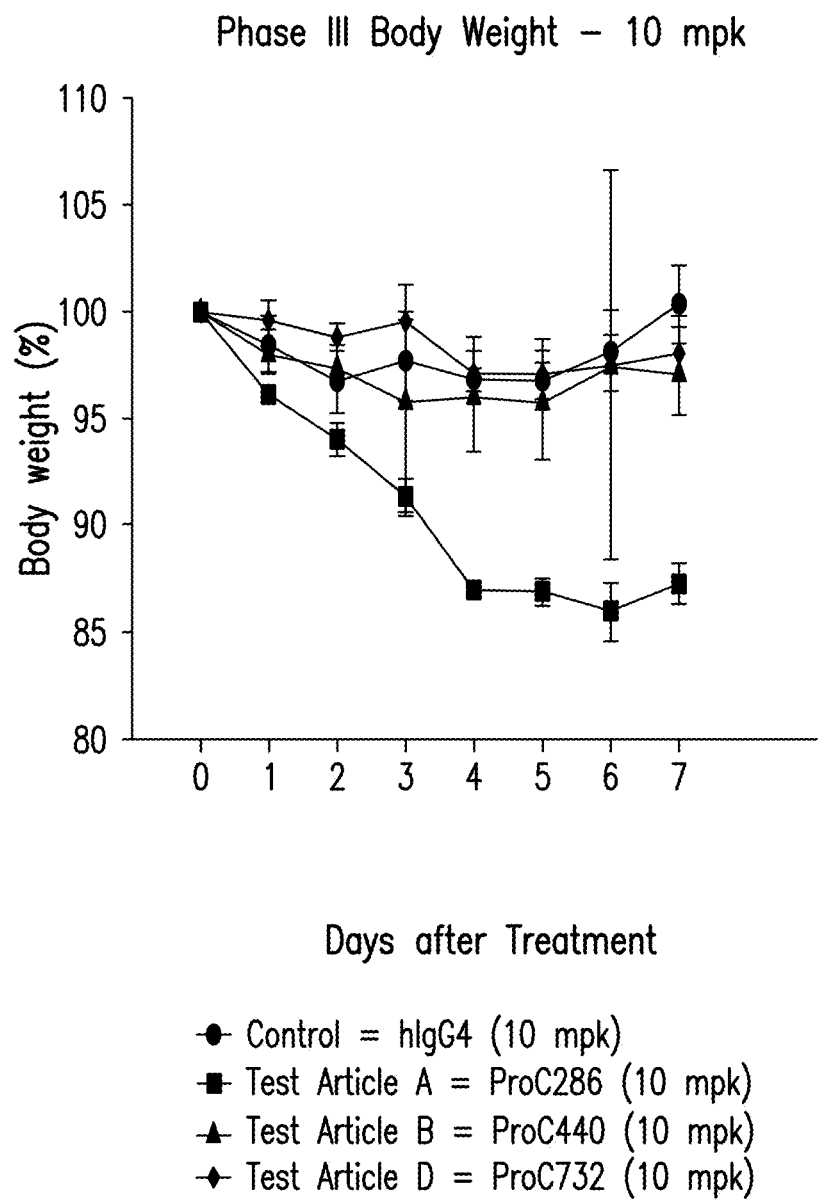
Figure 13C:
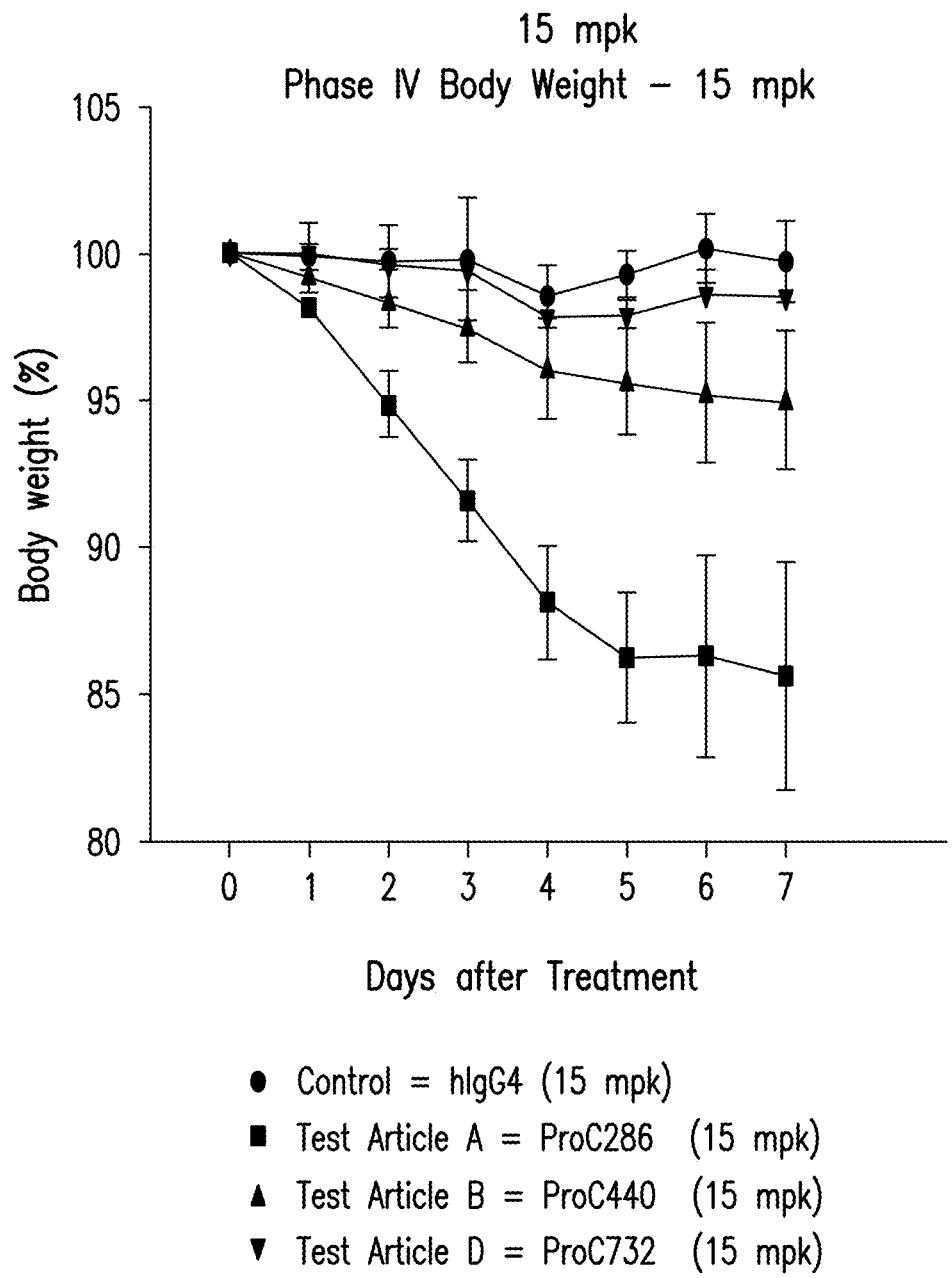
Figure 13D:
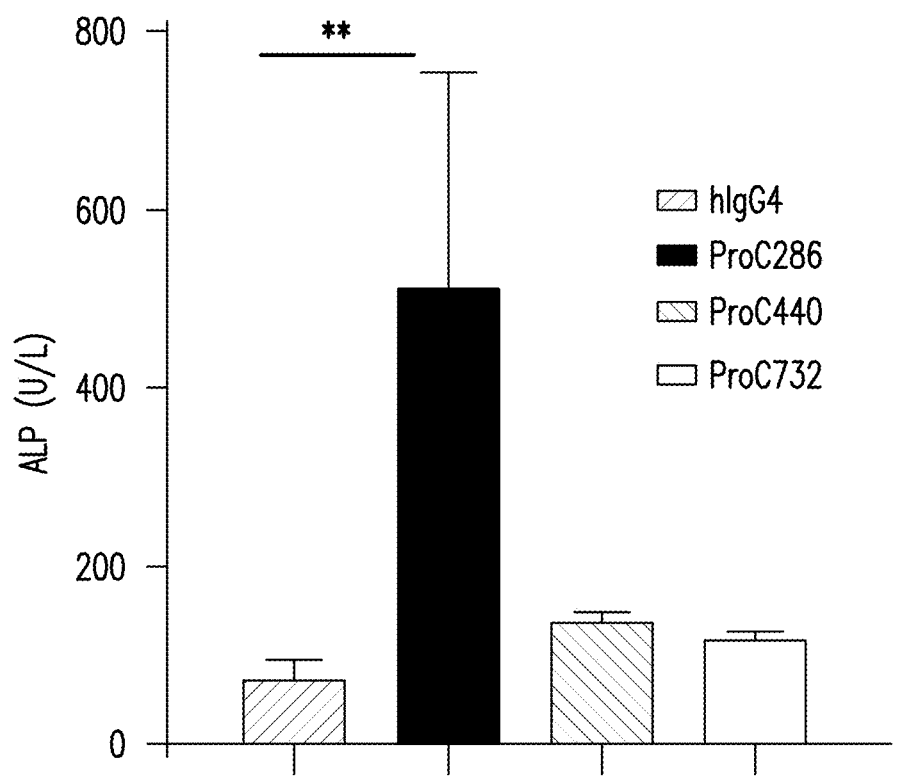
FIG. 13D shows INFa2b mediated toxicity in animals dosed with unmasked IFNa2b/Fc (ProC286) corresponding to increased ALP and increased therapeutic index of IFNa2b single mask (ProC440) and dual mask (ProC732).

Animal were dosed on day 1 with the indicated doses on FIGS. 13A-13C. Animals were kept on study for one week, unless a non-tolerated dose (DLT) was reached. Clinical observations, body weights & temperature were measured prior to dosing, and at 6 h, 24 h, 72 h, 7 d post-dose for each animal. Blood samples for Hematology and Chemistry analysis were collected at 72 h, 7 d post-dose for each animal. Hematology and Chemistry analysis were performed right after sampling. For the Hematology analysis, blood smear, differential white blood cell count, hematocrit, hemoglobin, mean corpuscular hemoglobin, mean corpuscular volume, platelet count, red blood cell (erythrocyte) count, red blood cell distribution width, reticulocyte count and white blood cell (leukocyte) count were evaluated. The clinical chemistry panel included measurement of alanine aminotransferase, albumin, albumin/globulin ratio, alkaline phosphatase, aspartate aminotransferase, calcium, chloride, cholesterol, creatine kinase, creatine, gamma glutamytransferase, globulin, glucose, inorganic phosphorus, potassium, sodium, total bilirubin, total protein, triglycerides, urea, nitrogen, and C-reactive protein. The evidence of toxicities in the tolerability study are summarized in FIGS. 13A-13C, 14, and 15.

Overall, animals dosed with the ProC286 constructs showed on average 5% body weight loss when dosed at 2 mpk (i.e., 2 mg/kg), and 15% body weight loss when dosed at 10 mpk and 15 mpk (FIGS. 13A-13C). One animal dosed with ProC286 at 15 mpk showed 20% body weight loss at 7 days post-dose (end of study). This is considered a non-tolerated dose. In contrast, animals dosed with ProC440 and ProC732 at 2 mpk and 10 mpk did not show body weight loss (FIGS. 13A-13B). Animals dosed with ProC440 at 15 mpk showed on average 5% body weight loss (FIGS. 13A-13C). Animals dosed with ProC732 at 15 mpk showed no body weight loss (FIG. 13C). This indicates that the masking of IFNα-2b to its receptor in the context of ProC440 limits IFNα-2b mediated bodyweight loss. Animals dosed with unmasked IFNa2b/Fc at 15 mpk showed elevated ALP (and increased ALP detected at 0.4 mpk) compared to animals dosed with masked and dual masked IFNa2b/Fc. The results indicate that the masked IFNa2b/Fc is well tolerated up to 15 mg/kg in the hamster toxicity model.

Without wishing to be bound by theory, it is believed that positioning the interferon N-terminal of the DD and using a relatively short LR inhibits cytokine activity in the context of ProC440, reducing the toxicity of the interferon in comparison to PEGylated IFNα-2b (Sylatron®) or ProC286. Unexpectedly, the addition of a peptide affinity mask at the N-terminus of the cytokine in the context of ProC732 fully abrogates IFNa-2b mediated bodyweight lost at a dose of at least 15 mpk. The use of both a cleavable peptide mask and a cleavable dimerization domain thus lowers toxicity and allows dosing at higher levels, potentially resulting in an improved therapeutic window for this cytokine therapeutic.

Figure 14:
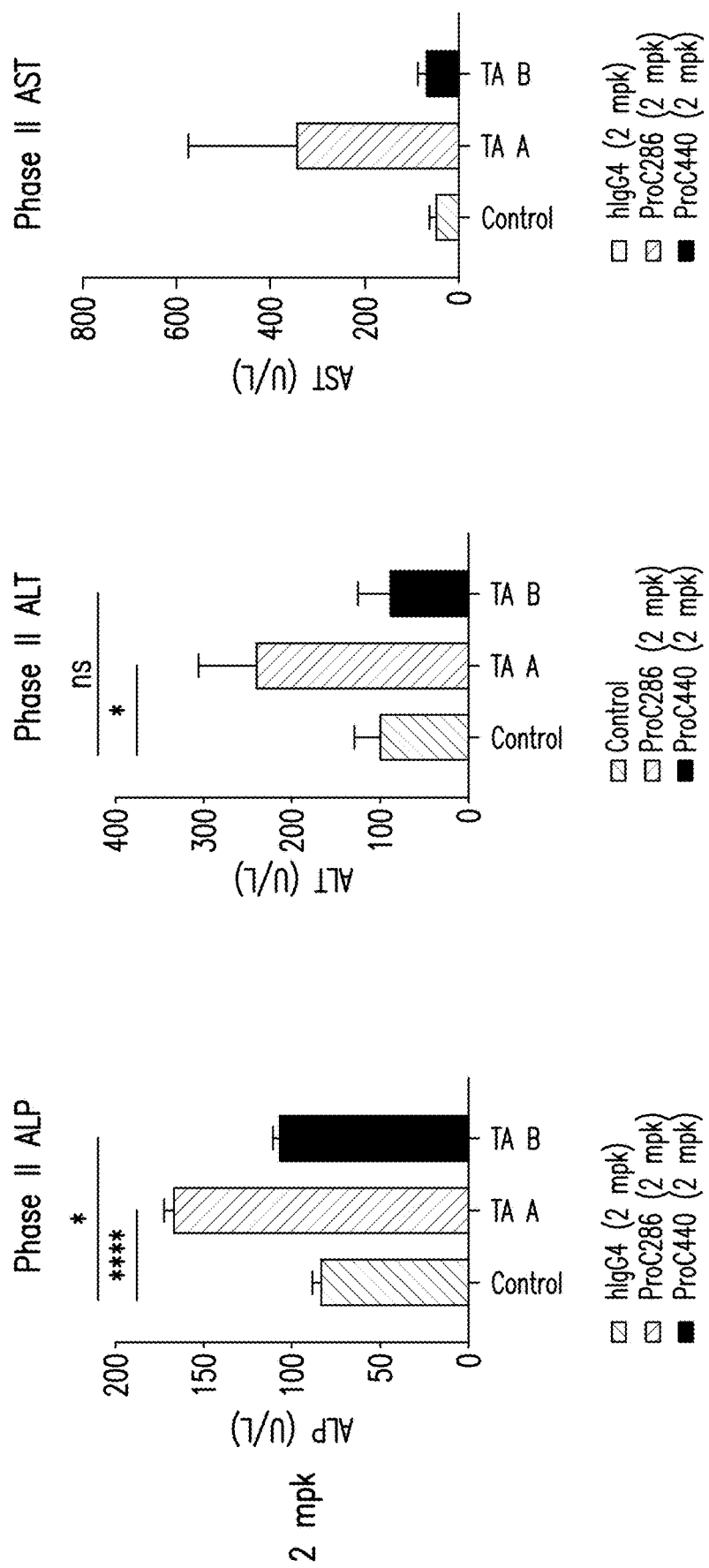
FIG. 14 shows clinical chemistry analysis outcomes (Alkaline phosphatase, Alanine transaminase, and Aspartate transaminase) of Syrian Gold Hamsters in response to different doses (2 mpk, 10 mpk, and 15 mpk) of cytokine constructs ProC286, ProC440, and ProC732 or control (human IgG4) in tolerability tests.
Figure 14:
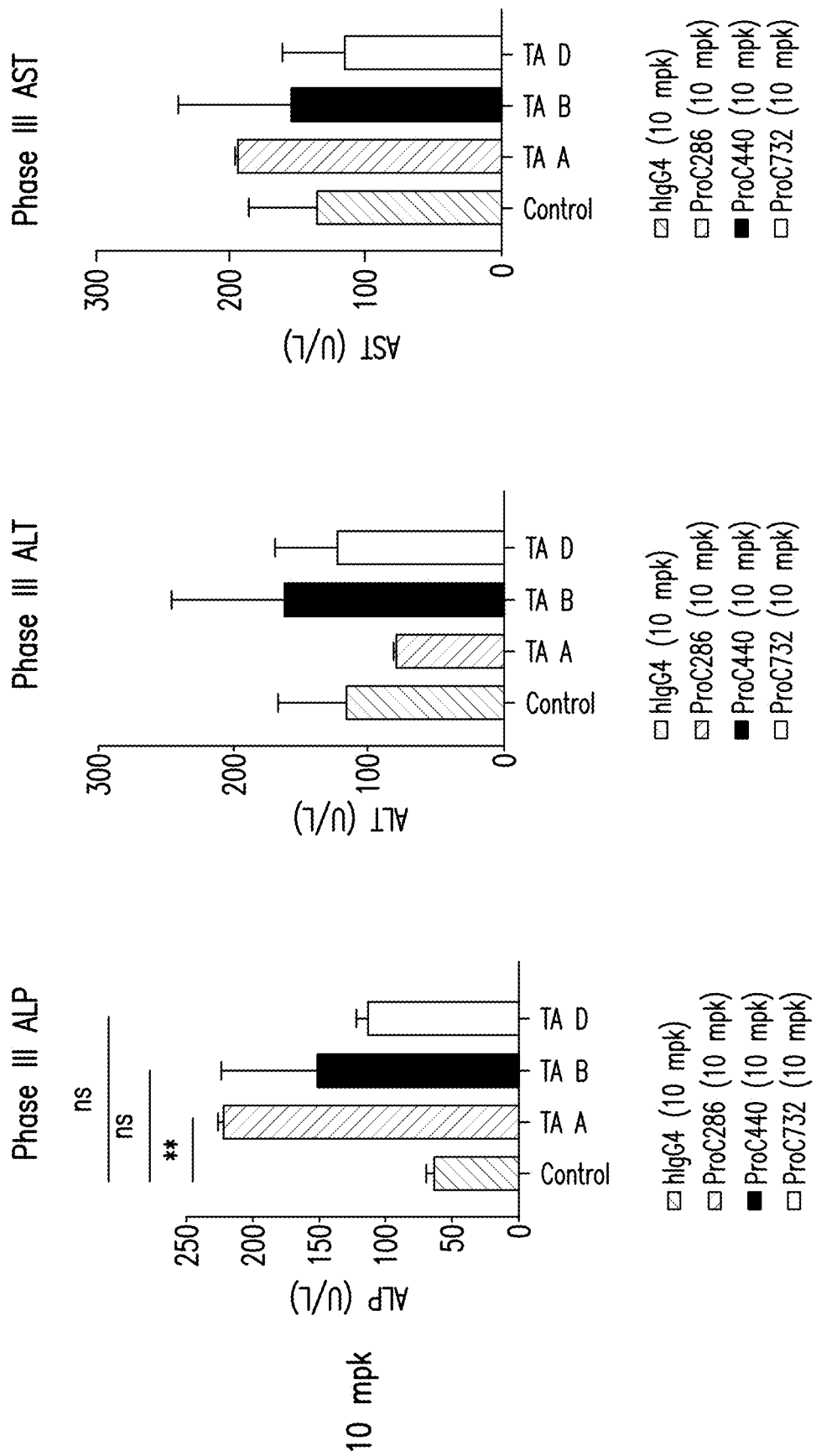
Figure 14:
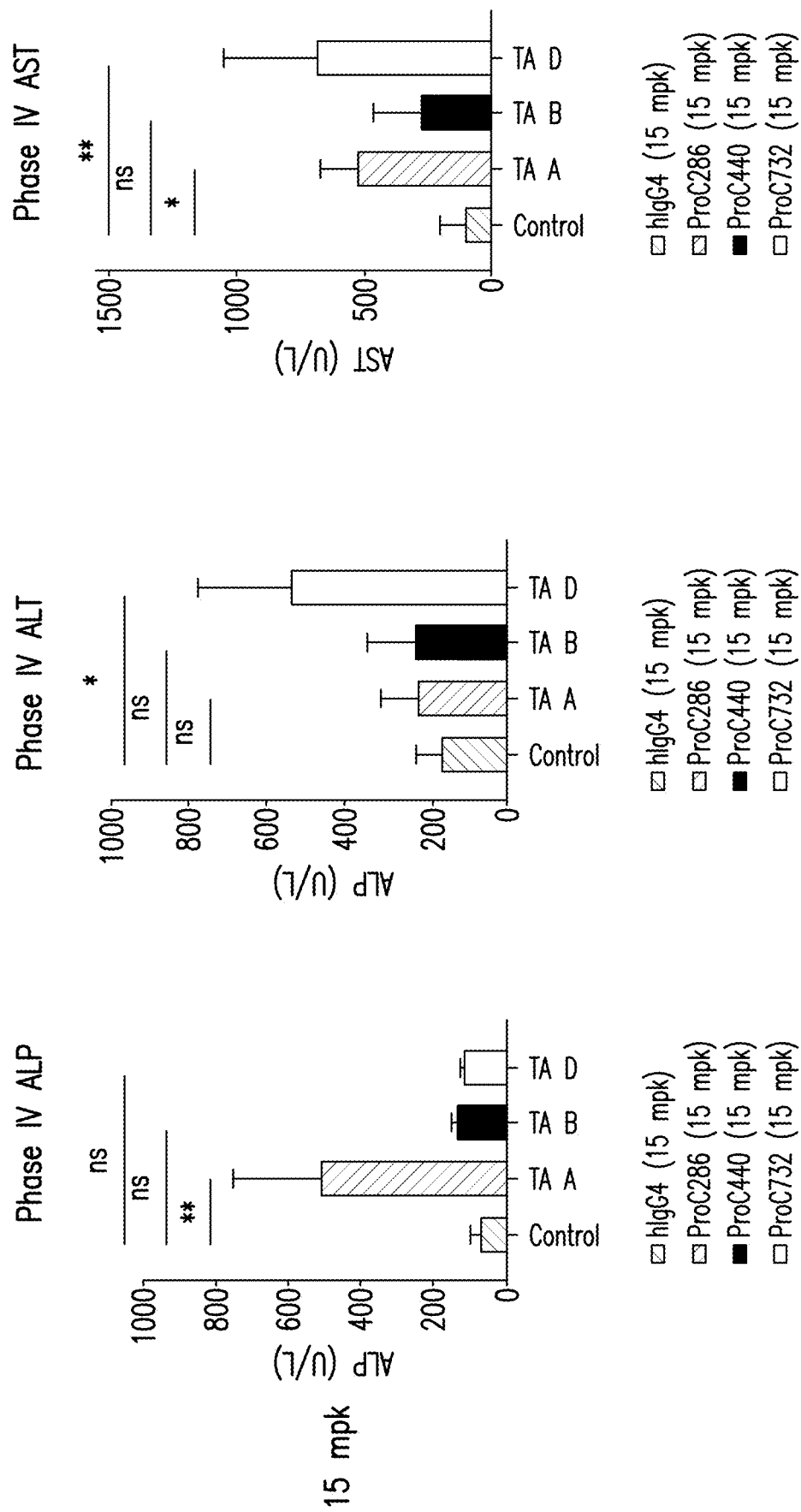

In terms of clinical chemistry, animals dosed with ProC286 showed significant elevation of Alkaline Phosphatase (ALP) at all doses (0.4 mpk, 2 mpk, 10 mpk and 15 mpk), 7 days post-dose (end of study) (FIG. 14). No significant increase of ALP was measured when animals were dosed with 10 mpk or 15 mpk of ProC440 or ProC732 (FIG. 14). Elevation of ALT is a marker of liver toxicity. IFNα-2b has been shown to induce liver toxicities. This indicates that the masking of IFNα-2b from binding to its receptor in the context of ProC440 and ProC732 limit IFNa-2b mediated liver toxicities.

Figure 15:
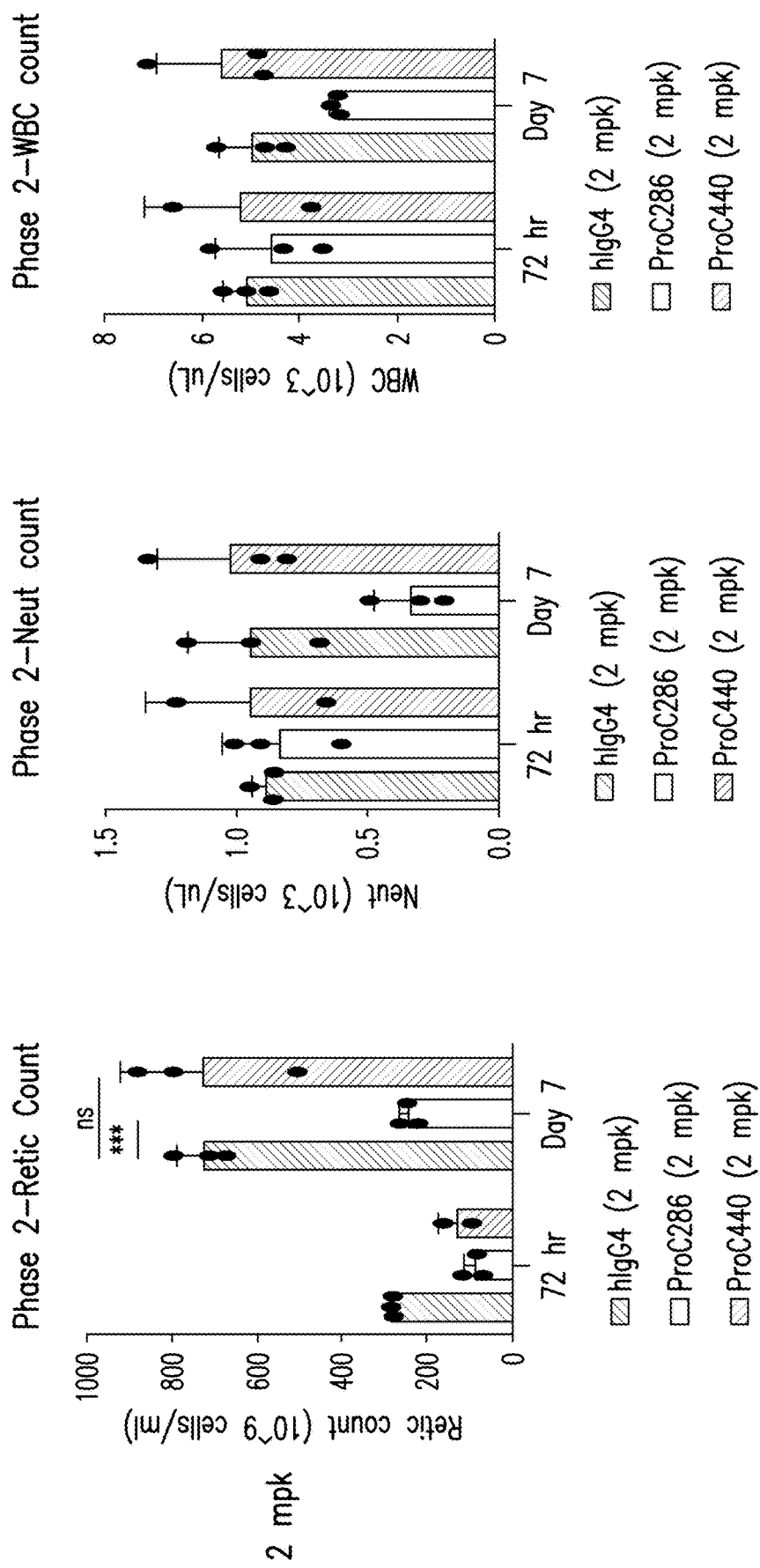
FIG. 15 shows hematology analysis outcomes (Reticulocyte, Neutrophil, and White Blood Cells (WBC) counts) in Syrian Gold Hamsters in response to different doses (2 mpk, 10 mpk, and 15 mpk) of cytokine constructs ProC286, ProC440, and ProC732 or control (human IgG4) in tolerability tests.
Figure 15:
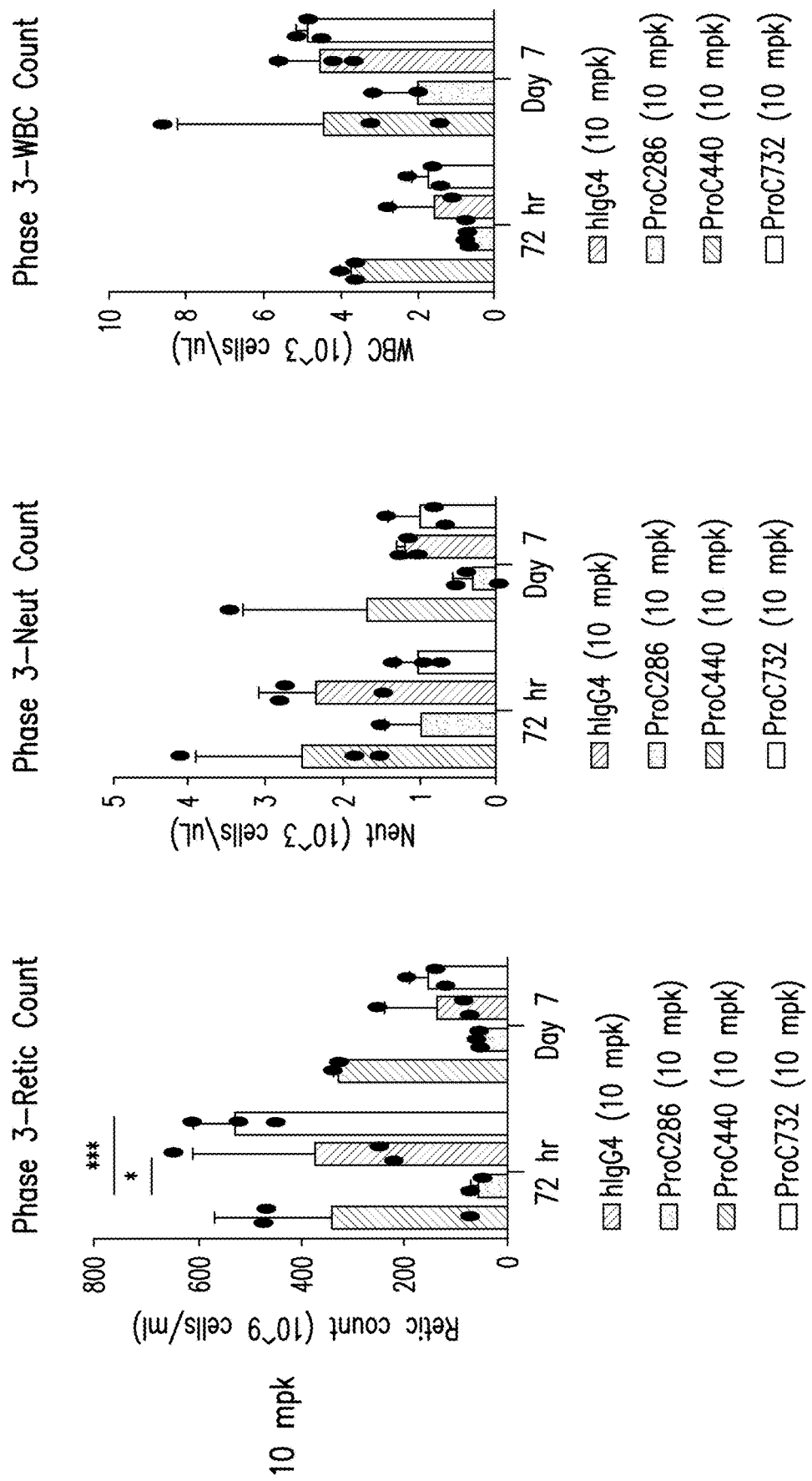
Figure 15:
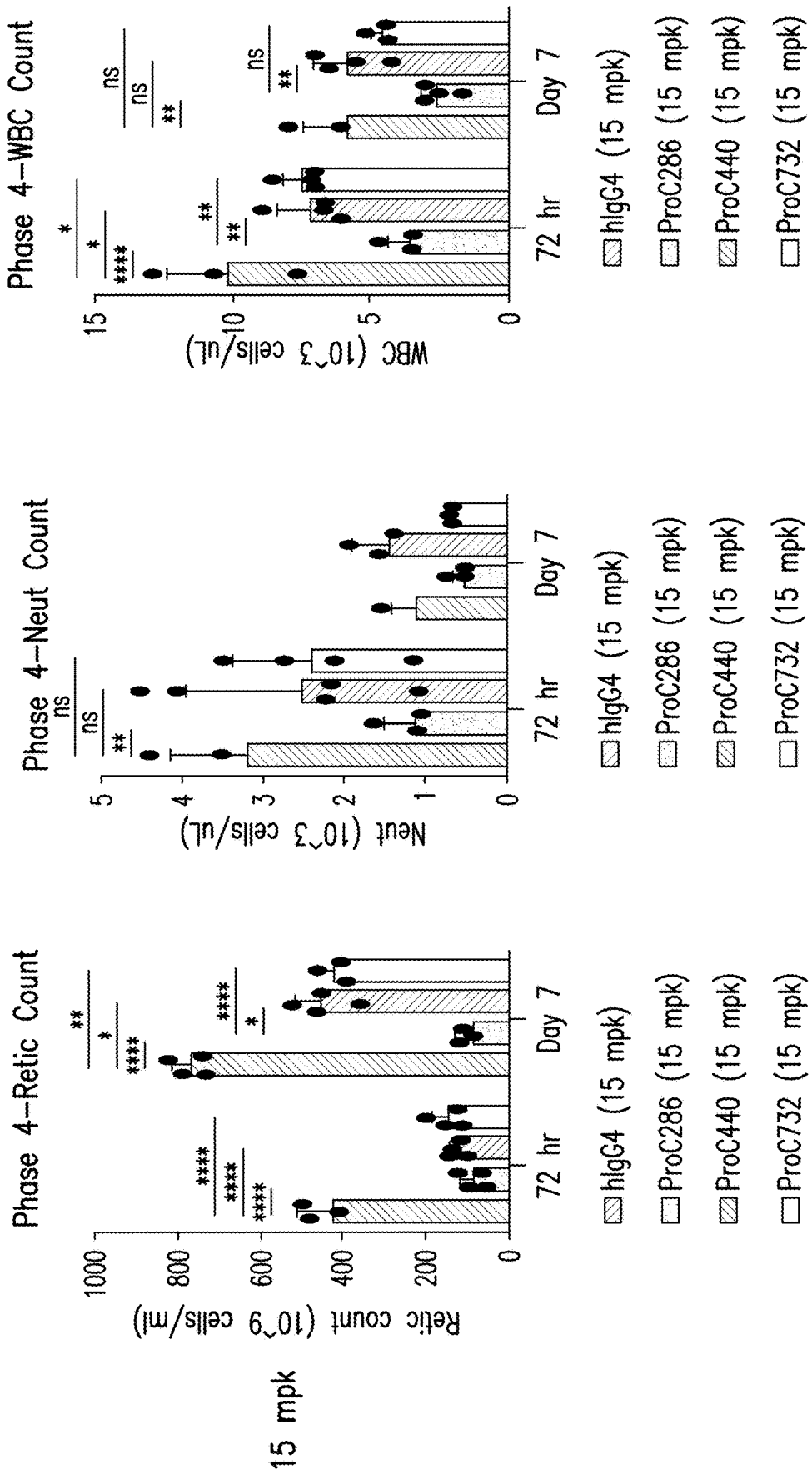

In terms of hematology, 3 days post-dose and 7 days post-dose (end of study), animals dosed with ProC286 at 2 mpk, 10 mpk and 15 mpk showed significant reduction level of Reticulocyte count, Neutrophyle count and White Blood Cells (WBC) count (FIG. 15). These reductions are reminiscent of IFNa-2b mediated bone-marrow toxicities. Three days post-dose, animals dosed with ProC440 and ProC732 showed reduction level of Reticulocyte count, Neutrophyle count and White Blood Cells (WBC) count (FIG. 15). Overall, the reduction level of hematopoietic cells observed in animals dosed with ProC440 and ProC732 is not as significant as the reduction levels observed in animals dosed with ProC286. At 7 days post-dose (end of study), in animals dosed with ProC732 and ProC440, the overall level of Reticulocyte count, Neutrophyle count and White Blood Cells (WBC) count is back to normal levels, or to a similar level that what observed in animals dosed with the negative control IgG4 (FIG. 15). In animals dosed with ProC286, the level of Reticulocyte count, Neutrophyle count and White Blood Cells (WBC) count remains low. This indicates that the masking of IFNα-2b to its receptor in the context of ProC440 and ProC732 limit IFNa-2b mediated bone marrow toxicities.

Example 3. In Vitro Anti-Proliferative Effect of Cytokine Constructs with Linkers of Various Lengths on Cancer Cells The anti-proliferative effects of IFNa-2b-hIgG4 Fc fusion constructs with varying linker lengths or without a linker between the IFNa-2b and the hIgG4 Fc were tested in vitro using Daudi cells. The test was performed using the Daudi cell assay described in Example 1.

The fusion proteins tested in this experiment include, in an N- to C-terminal direction, the mature IFNalpha-2b cytokine sequence, an optional linker and/or cleavable moiety, and the Fc domain of human IgG4 of SEQ ID NO: 4 (including the full hinge region such that the N-terminus of the Fc sequence begins with the amino acid sequence ESKYGPPCPPC...) (SEQ ID NO: 500) (first eleven amino acids of SEQ ID NO:4). The ESKYGPP (SEQ ID NO: 317; first seven amino acids of SEQ ID NO:4) sequence contributes 7 amino acids to the "linking region" of these constructs. The first construct (Linking Region=7) construct has no linker or cleavable moiety; its sequence in the N- to C-terminal direction consists of SEQ ID NO: 1 fused to SEQ ID NO: 4. The second construct (Linking Region=12) construct has a 5 amino acid linker SGGGG (SEQ ID NO: 492) and no CM; its sequence in the N- to C-terminal direction consists of SEQ ID NO: 1 fused to SEQ ID NO: 492 fused to SEQ ID NO: 4. The third construct (Linking Region=18) includes a 7 amino acid CM (SGRSDNI) (SEQ ID NO: 100) and a 4 amino acid linker GGGS (SEQ ID NO: 228); its sequence in the N- to C-terminal direction consists of SEQ ID NO: 1 fused to SEQ ID NO: 100 fused to SEQ ID NO: 2 fused to SEQ ID NO: 4. The fourth construct (Linking Region=23) includes a 5 amino acid linker, a 7 amino acid CM, and a 4 amino acid linker; its sequence in the N- to C-terminal direction consists of SEQ ID NO: 1 fused to SEQ ID NO: 492 fused to SEQ ID NO: 100 fused to SEQ ID NO: 2 fused to SEQ ID NO: 4. The fifth construct (Linking Region=24) includes a 13 amino acid CM (ISSGLLS-GRSDNI) (SEQ ID NO: 68) and a 4 amino acid linker; its sequence in the N- to C-terminal direction consists of SEQ ID NO: 1 fused to SEQ ID NO: 68 fused to SEQ ID NO: 2 fused to SEQ ID NO: 4.

FIG. 16 shows the activities of the above ACCs in Daudi cells. The ACCs tested in this example did not have a peptide affinity mask attached thereto. The data indicates that the length of the flexible linkers and the length of the Linking Region (LR) between the cytokine and the Fc domain had an impact on the activity of the (uncleaved) ACCs. Constructs with zero linkers, or short linkers, and a correspondingly short LR display reduced cytokine activity, whereas constructs with longer linkers and thus a longer LR have a higher level of cytokine activity.

Example 4. In Vitro Characterization of Additional Activatable Cytokine Constructs Additional activatable cytokine constructs without a peptide mask were also prepared by recombinant methods. The $1^{st}$ and $2^{nd}$ monomer constructs of these ACCs were identical. Each of the $1^{st}$ and $2^{nd}$ monomer constructs comprises, from N-terminus to C-terminus, a signal sequence, a mature cytokine protein that corresponds to human interferon alpha-2b (SEQ ID NO: 1), a cleavable moiety (CM) having amino acid sequence of SEQ ID NO: 100 (SGRSDNI), and a dimerization domain corresponding to human IgG4 S228P Fc (comprising SEQ ID NO: 3). In addition, these ACCs include or not a linker having the amino acid sequence SGGGG (SEQ ID NO: 492) between the CP and the CM. These ACCs include or not a linker having the amino acid sequence GGGS (SEQ ID NO: 228) between the CM and DD. These ACCs also contain or not portions of the hinge of the DD that are N-terminal to Cysteine 226 (by EU numbering). These additional activatable cytokines constructs are described in Table 6.

TABLE 6

Activable cytokines having different lengths of the linking region

| Name | Alternative Name | Linker between CP and CM | Linker between CM and DD | Fc Hinge N-terminal residues | Linking Region Length |
|---|---|---|---|---|---|
| ProC288 | IFNa2b 1204DNI 0AA Fc | SGGGG (SEQ ID NO: 492) | absent | absent | 12 |
| ProC289 | IFNa2b 1204DNI 3AA Fc | SGGGG (SEQ ID NO: 492) | absent | GPP | 15 |
| ProC290 | IFNa2b 1204DNI 7AA Fc | SGGGG (SEQ ID NO: 492) | absent | ESKYGPP (SEQ ID NO: 317) (first seven amino acids of SEQ ID NO: 4) | 19 |
| ProC291 | IFNa2b 1204DNI 11AA Fc | SGGGG (SEQ ID NO: 492) | GGGS (SEQ ID NO: 2) | ESKYGPP (SEQ ID NO: 317) (first seven amino acids of SEQ ID NO: 4) | 23 |

TABLE 6-continued

Activable cytokines having different lengths of the linking region

| Name | Alternative Name | Linker between CP and CM | Linker between CM and DD | Fc Hinge N-terminal residues | Linking Region Length |
|---|---|---|---|---|---|
| ProC440 | N IFNa2b 0 1204DNIdL 0AA Fc | absent | absent | absent | 7 |
| ProC441 | N IFNa2b 0 1204DNIdL 3AA Fc | absent | absent | GPP | 10 |
| ProC442 | N IFNa2b 0 1204DNIdL 7AA Fc | absent | absent | ESKYGPP (SEQ ID NO: 317) (first seven amino acids of SEQ ID NO: 4) | 14 |
| ProC443 | N IFNa2b 0 1204DNIdL 11AA Fc | absent | GGGS (SEQ ID NO: 2) | ESKYGPP (SEQ ID NO: 317) (first seven amino acids of SEQ ID NO: 4) | 18 |

The activity of ProC440, an ACC with no flexible linkers and an IgG4 Fc region truncated to Cys226 (i.e., comprising a linking region of 7 amino acids), and the activity of additional ACCs containing various flexible linkers and Fc region sequences (i.e., comprising linking regions having more than 7 amino acids) was tested in vitro using IFN-responsive HEK293 cells and Daudi cells as previously described. In both assays, the activity (e.g., anti-proliferative effects) of ProC440 was reduced as compared to all other ACCs with longer linking regions, which contain various additional sequences between the cytokine and the first amino acid that binds the DD to the corresponding second monomer (i.e., Cys226 of IgG4 by EU numbering). EC50 values for the ACCs were computed from the IFNα/β assay results and are provided below in Table 7.

TABLE 7

EC50: IFNα/β Reporter Assay

| | Pro C288 | Pro C289 | Pro C290 | Pro C291 | Pro C440 | Pro C441 | Pro C442 | Pro C443 |
|---|---|---|---|---|---|---|---|---|
| EC50 | 34.34 | 17.93 | 10.33 | 8.743 | 41.37 | 6.28 | 6.637 | 1.687 |

EC50 values for the ACCs were computed from the Daudi apoptosis assay results and are provided below in Table 8.

TABLE 8

EC50: Daudi Apoptosis Assay

| | Pro C288 | Pro C289 | Pro C290 | Pro C291 | Pro C440 | Pro C441 | Pro C442 | Pro C443 |
|---|---|---|---|---|---|---|---|---|
| EC50 | 112.8 | 64.55 | 23.04 | 13.39 | 2078 | 1053 | 642.9 | 478 |

The data in Tables 7-8 also shows that the activity of the (uncleaved) ACCs could be modulated by varying the length of the Linking Region.

The ACCs tested in this Example 4 do not comprise a peptide mask. Based on the experimental results reported herein comparing ProC440 with ProC732, the activity of the uncleaved ACCs may be further decreased by adding a cleavable moiety and peptide mask to the N-terminus of the cytokine construct. Likewise, based on the data herein comparing ProC440 and ProC732, ACCs further comprising a CM and a PM at the N-terminus may have increased masking efficiency compared to ACCs that do not comprise a PM.

Example 5. Universal Cytokine Constructs

Figure 17:
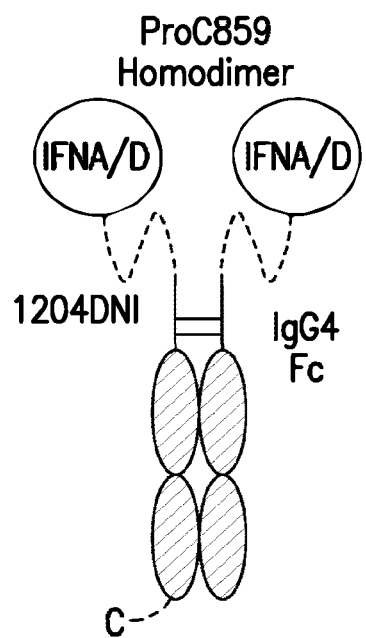
FIG. 17 depicts the structure of ACC ProC859 mouse cross-reactive interferon (top), the anti-proliferative effects of ACC ProC859 in a B16 mouse melanoma cell assay and the activity of ACC ProC859 in the IFN-responsive HEK293 assay.

A universal activatable cytokine construct was prepared by recombinant methods described herein. The universal ACC has a universal interferon sequence (ProC859) having activity on both human and mouse cells as shown in FIG. 17. The universal ACC is a dimer. The $1^{st}$ and $2^{nd}$ monomer constructs of this ACC were identical, with each being a polypeptide having the amino acid sequence of SEQ ID NO: 480 with a signal sequence at its N-terminus. Each of the $1^{st}$ and $2^{nd}$ monomer constructs comprises, from N-terminus to C-terminus, a signal sequence, a mature cytokine protein that corresponds to a universal interferon molecule that is a hybrid of IFN alpha 1 and IFN alpha 2a (SEQ ID NO: 481), a cleavable moiety having the amino acid sequence of SEQ ID NO: 100, and a dimerization domain corresponding to human IgG Fc (SEQ ID NO: 3).

The activity of the universal cytokine construct was tested in vitro using IFN-responsive HEK293 cells and B16 mouse melanoma cells. The activity of ProC859 was reduced at least 150X as compared to mouse IFNa4. Protease activation with uPa restored activity to a level that is comparable to mouse IFNa4 as shown in FIG. 17 (bottom panel). EC50 values for ACC ProC859, ACC ProC859+uPA, and mouse IFNα4 were computed from the assay results and are provided in FIG. 17 (bottom panel).

| EC50: B16 IFNα/β Reporter Assay | | |
|---|---|---|
| | ProC859 (ACC) | ProC859 (ACC) + uPA | IFNa4 |
| EC50 | 293.7 | 1.951 | 1.966 |

An ACC with universal IFN and a peptide mask according to the present disclosure may be prepared by recombinant methods described herein. The peptide masks are coupled to the universal interferon to further reduce the cytokine activity of the ACC compared to ProC859. The 1st and 2nd monomer constructs of this ACC are identical, with each being a polypeptide having the amino acid sequence. Each of the 1st and 2nd monomer constructs comprises, from N-terminus to C-terminus, a signal sequence (for example, one of SEQ ID NOs: 242-244), a masking peptide (e.g., any one PM selected from the group consisting of SEQ ID NOs: 323, 328-479), an optional linker (e.g., any one selected from SEQ ID NO:2, or SEQ ID Nos: 210-263), a cleavable moiety (e.g., any one selected from SEQ ID NOs: 5-100, and 264-279), an optional linker (e.g., any one selected from SEQ ID NOs: 2, 210-263, 324, 325, 327), a mature cytokine protein that corresponds to a universal interferon molecule that is a hybrid of IFN alpha 1 and IFN alpha 2a (SEQ ID NO: 481), a cleavable moiety having the amino acid sequence of SEQ ID NO: 100, and a dimerization domain corresponding to human IgG Fc (SEQ ID NO: 3). The activity of the universal ACC is tested in vitro using IFN-responsive HEK293 cells and B16 mouse melanoma cells. Based on the experimental results reported herein comparing ProC440 with ProC732, it is expected that the presence of the affinity mask (PM) will further decrease the cytokine activity of the uncleaved ACC relative to ProC859, but will permit full recovery of cytokine activity when the CMs are cleaved by protease, thereby further reducing toxicity and improving the therapeutic window.

Without wishing to be bound by theory, based on the results presented herein, the inventors envisage that use of an affinity mask (PM) at the N-terminus of a cytokine in addition to the use of a DD with a relatively short LR at the C-terminus of the cytokine will provide significant masking of cytokine activity for cytokines in addition to the interferon-alpha cytokines exemplified in the foregoing specific examples. As described above, the invention described herein encompasses activatable cytokine constructs that include various cytokine proteins discussed herein. As non-limiting examples, the CP used in the ACCs of the invention may be any of those listed in SEQ ID NOs: 101 to 209, and variants thereof. In particular, monomeric cytokines are suited to use in the ACCs described herein. Based on the results provided herein, it is believed that the ACCs of the invention will exhibit reduced cytokine activity relative to the corresponding wildtype cytokine, and that upon cleavage of the ACC by the relevant protease(s), the cleavage product will recover cytokine activity similar to that of the corresponding wildtype cytokine.

Example 6: Tolerability of Cytokine Constructs in Non-Human Primates

In prior studies using conventional half-life-extended IFN-a2b (pegylated IFN-a2b-reference PEG-IFN BLA #99-148, RMS #1039494 Study 95028) (PEG-IFN, PEG-INTRON™) in cynomolgus monkeys, it was reported that a single subcutaneous dose of 117,721 ug/$m^2$ (approximately 9.8 mg/kg) was associated with transient inappetence, hypothermia, hypotension, and death of multiple animals. In those prior studies using pegylated IFN-a2b, it was reported that the no-observed-adverse-effect level (NOAEL) was ~4.9 mg/kg in males (58,860 μg/$m^2$) and ~2.5 mg/kg in females (29,440 μg/$m^2$).

In this Example, to assess the tolerability of the peptide masked IFNα-2b ACC construct (ProC732) in non-human primates, cynomolgus monkeys were dosed via subcutaneous administration at doses of 0.03, 0.30, 3.0 and 15 mg/kg of body weight. The monkeys (N=2 per group, mixed gender) received one dose of masked ACC and were kept on study up to 14-28 days post dose. Plasma concentrations were measured over time as shown in FIG. 39.

All animals were observed cage-side at least twice a day (am/pm) for signs of ill health, morbidity, mortality, injury, viability, and availability/accessibility of food and water. Whole blood was collected, in appropriate anticoagulant tubes, at approximately 48 hours postdose (Day 3) and on Days 7, 15, 22, and 29.

Hematology parameters included the following: White blood cell count; Mean cell volume; Absolute differential leukocyte count; Mean cell hemoglobin; Red blood cell count; Mean cell hemoglobin concentration; Hemoglobin; Platelet count; Hematocrit; Red cell distribution width; Reticulocyte count.

Clinical chemistry parameters included: Sodium; Potassium; Chloride; Alkaline phosphatase; Alanine aminotransferase; Aspartate aminotransferase; Glucose; Blood urea nitrogen; Creatinine; Gamma-glutamyl transferase; Total cholesterol; Triglycerides; Total protein; Albumin; Globulin (calculated); Albumin/globulin ratio (calculated); Calcium; Inorganic phosphorus; Total bilirubin.

Cytokines evaluated included the following: IL-2; IP-10 (CXCL 10); IL-6; IL-12p70; IFN-gamma; IL-10. The concentration of IP-10 in plasma was measured by MSD V-PLEX assay (Meso Scale Diagnostics, Rockville, Md.) as shown in FIG. 40A and plotted against ProC732 plasma concentration as shown in FIG. 40B.

Additionally, a fraction of whole blood samples were shipped overnight to the analytical laboratory for analysis by flow cytometry within 24 to 36 hours post-collection. FAC evaluations included the following: Viability/CD20/CD45/CD14/CD3/CD159a/CD4/Ki67/CD8/PD-L1.

Overall, animals treated with the ProC732 at all dose levels demonstrated no clinical signs of adverse effect. There were no signs of inappetence, hypothermia, hypotension, or body weight loss. Clinical biochemistry and hematology analysis performed at day 3, day 7, day 15 postdose indicated no deviations from prespecified normal ranges for all parameters with a single exception: a single animal treated with 15 mg/kg of ProC732 demonstrated elevated AST parameter 3 days after the drug administration. In cynomolgus monkey peptide masked IFNα-2b ACC construct (ProC732, also referred to as Pb-IFN-alpha2b) demonstrated linear pharmacokinetics and extended half-life, and was well tolerated at doses up to 15 mg/kg. The results are summarized in the following table:

| | 0.03 mg/kg | 0.3 mg/kg | 3 mg/kg | 15 mg/kg |
|---|---|---|---|---|
| Adverse events | – | – | – | – |
| AST elevation | – | – | – | +/– |
| WBC reduction | – | – | – | +/– |
| Ki67 increase in NK, T-cells | – | – | + | + |
| IP-10 elevated | – | – | + | ++ |

Overall, these results indicated increased tolerability of the conditionally masked IFN-a2b of the present disclosure up to the highest tested dose of 15 mg/kg in both males and females when compared to conventional half-life-extended IFN-a2b.

Figure 19:
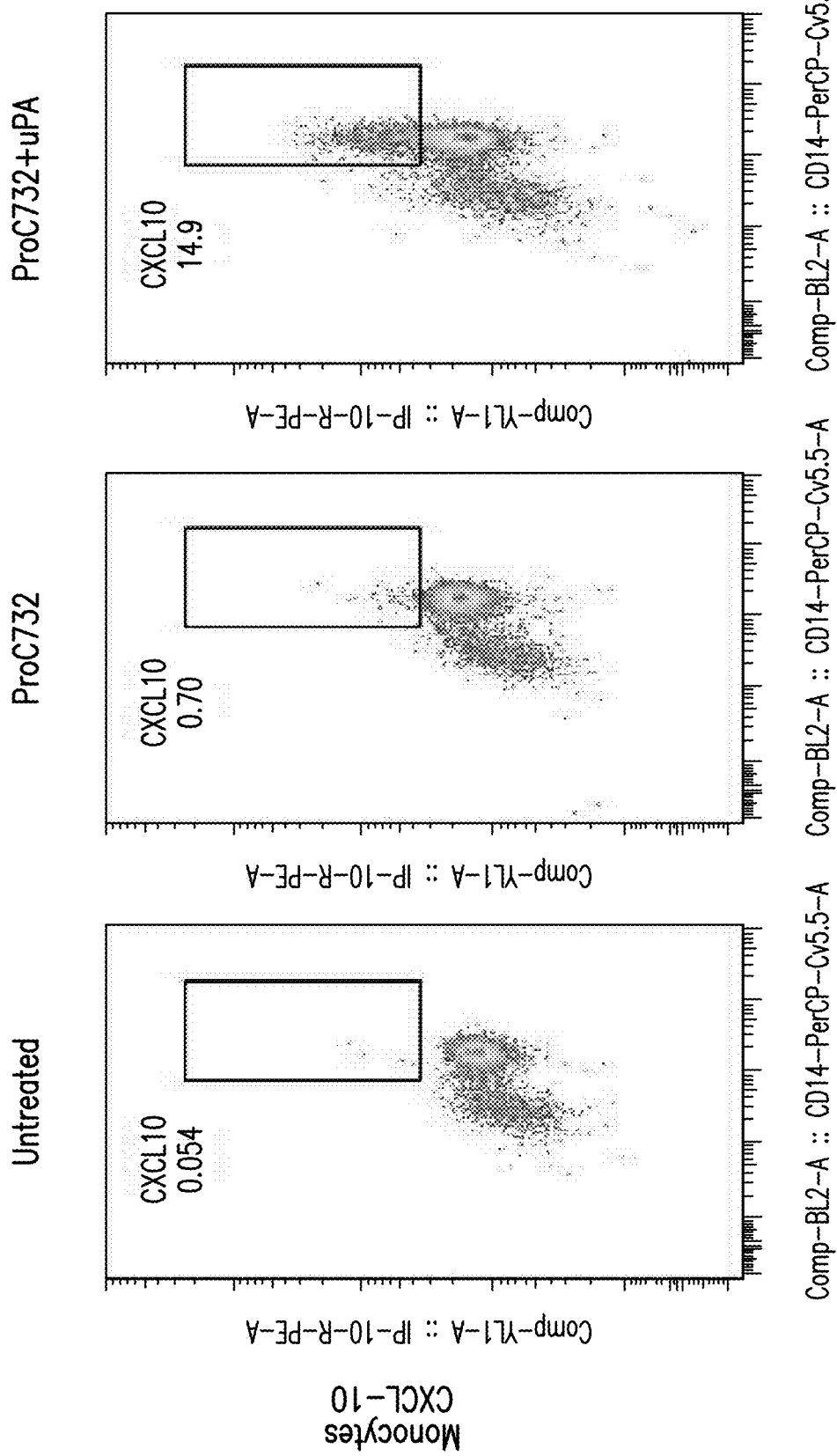
FIG. 19 shows activation-dependent effects of ProC732 on primary human cells. Top row indicates induction of IP-10 in myeloid cells in myeloid cells by activated ProC732, bottom row indicates induction of IFN-gamma in T and NK lymphocytes.
Figure 19:
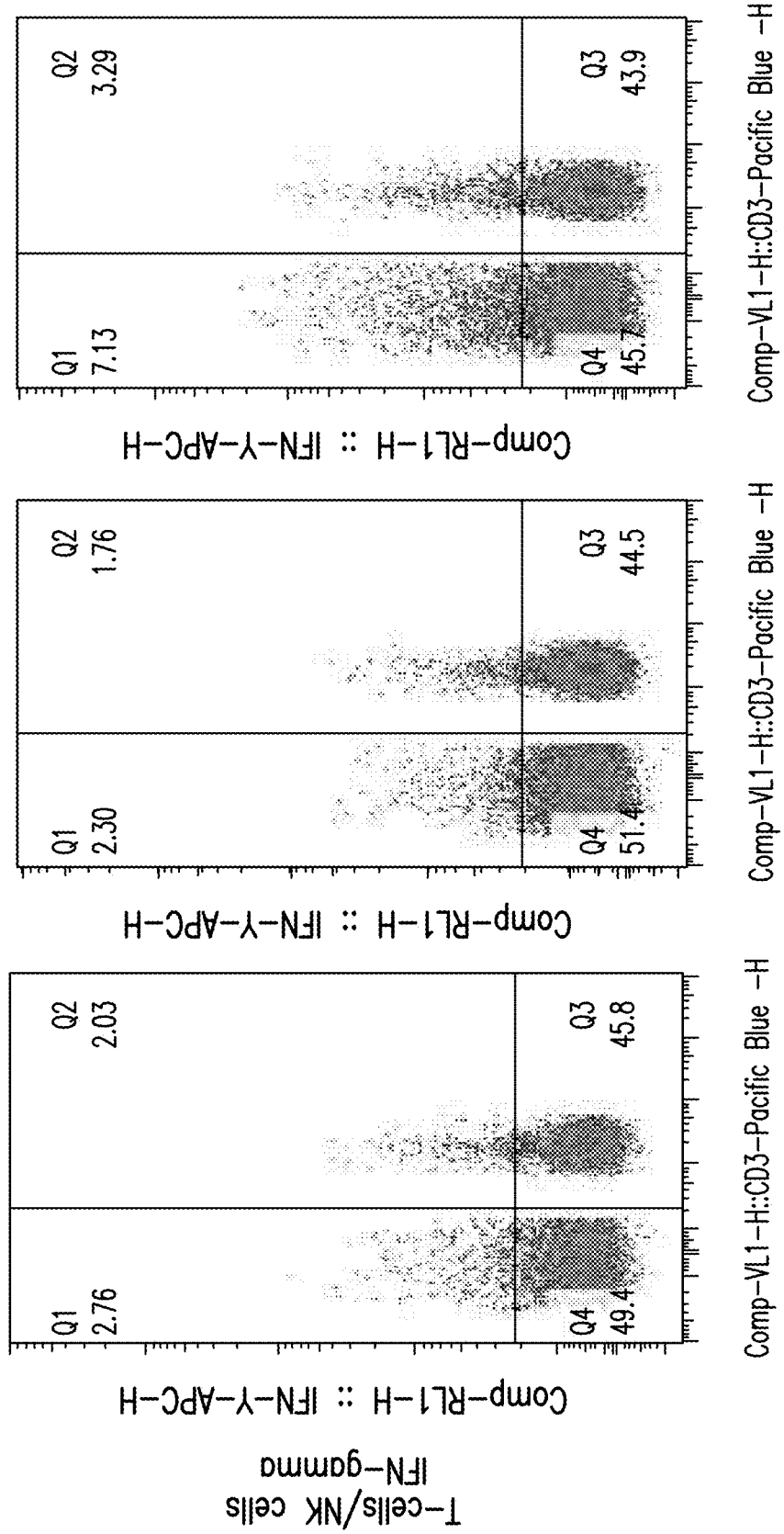

Example 7: In Vitro Characterization of CXCL10 and IFN-Gamma Induced Release by PBMC CXCL-10 and IFN-gamma induced release in healthy donor peripheral blood mononuclear cells (PBMC) was assessed in vitro using untreated PBMC and PBMC treated with peptide masked IFNα-2b ACC construct (ProC732) or ProC732 activated by in vitro protease treatment for 5 hours in the presence of Brefeldin A at doses of 1 ng/ml (FIG. 19, top row) or 10 ng/ml (FIG. 19, bottom row). Cells were stained for CD3/CD19/CD14, fixed/permeabilized, and stained for intracellular expression of CXCL10 and IFN-gamma. Gating was based on viable monocytes (FIG. 19, top row) or viable CD19-negative lymphocytes (FIG. 19, bottom row). These results show that ProC732 induces release of CXCL10 and IGN-gamma from PBMC in an activation dependent manner.

Example 8: In Vivo Tumor Suppression by Masked IFNα-2b

Figure 20:
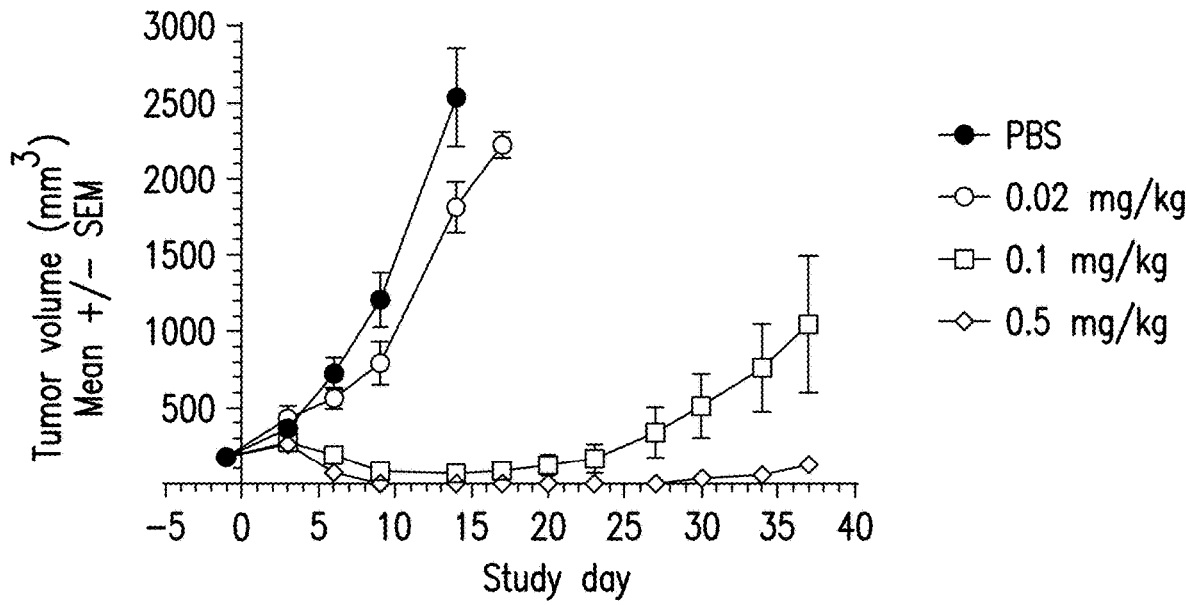
FIG. 20 shows in vivo efficacy of masked IFN-a2b (ProC732) at increasing concentrations in the Daudi xenograft model.

Tumor suppressive effect of the masked IFNα-2b ACC construct (ProC732) was assessed in vivo using Beige/SCID mice implanted subcutaneously with 10×10$^6$ Daudi cells grown in serum-free medium (1:1 Matrigel). Tumor measurements were recorded twice weekly over the duration of the study as indicated on the x-axis of the graph shown in FIG. 20. Mice (n=8 per group) were treated with PBS (control) or ProC732 at doses of 0.02 mg/kg, 0.1 mg/kg, and 0.5 mg/kg once a week for five weeks. Treatment was initiated once average tumor volume reached approximately 200 mm$^3$. As shown in FIG. 20, a dose-dependent reduction in mean tumor volume was observed for mice treated with conditionally active ProC732. ProC732 induced complete regression at doses as low as 0.1 mg/kg out to study day 20 and a dose of 0.5 mg/kg induced complete regression for the duration of the study.

Figure 36:
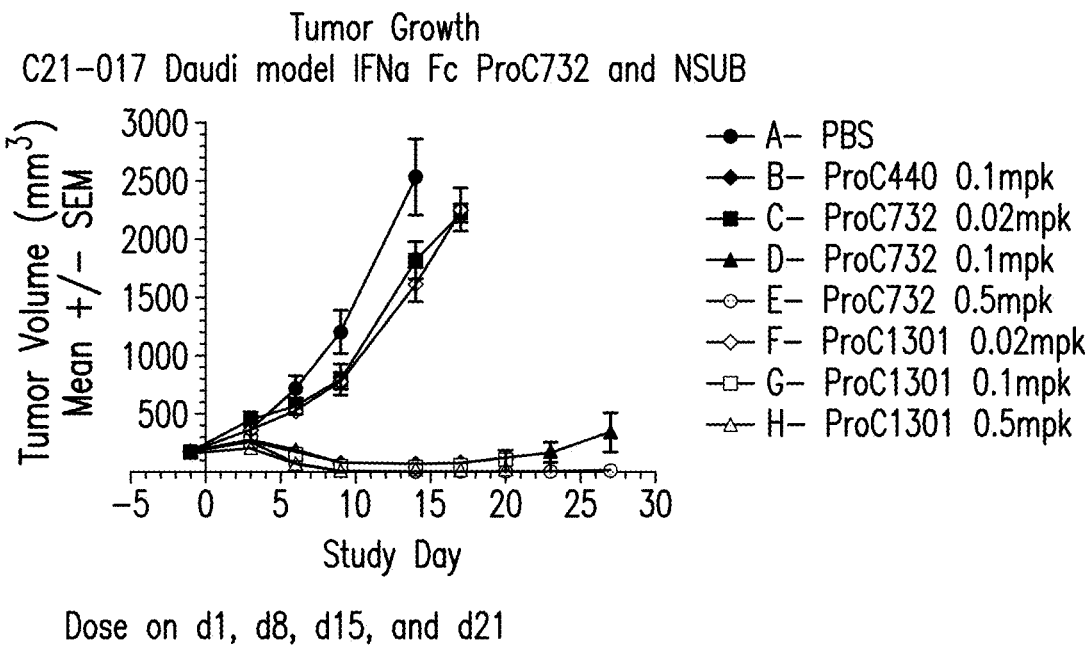
FIG. 36 shows tumor growth suppression activity of ProC440, ProC732, and ProC1301 as a function of concentration.

FIG. 36 shows ProC732 and ProC1301 inhibited tumor volume growth in a dose-dependent manner. ProC440, ProC732, and ProC1301 showed complete tumor suppression at a dose of 0.1 mg/kg.

Example 9: In Vitro Activation of Mouse Splenocytes by IFNα A/D

The ability of masked activatable IFNα A/D (ProC1023) or uncleavable IFNα A/D to stimulate release of IP-10 in mouse splenocytes was tested in vitro. IFNα A/D (SEQ ID NO: 481) was prepared as described in Rehberg et al. (Rehberg, et al. Specific molecular activities of recombinant and hybrid leukocyte interferons. J Biol Chem. 1982; 257: 11497-502), which is incorporated by reference herein in its entirety. Control uncleavable IFNα A/D was constructed by replacing protease cleavage sites with an uncleavable linker sequence. Masked activatable IFNα A/D was activated in vitro by incubation with uPA at a 1:250 molar ratio. Mouse splenocytes were treated with masked activatable IFNα A/D, with and without protease treatment, or uncleavable IFNα A/D for 24 hours. IP-10 levels were determined with a standard ELISA assay using conventional methods.

Figure 21:
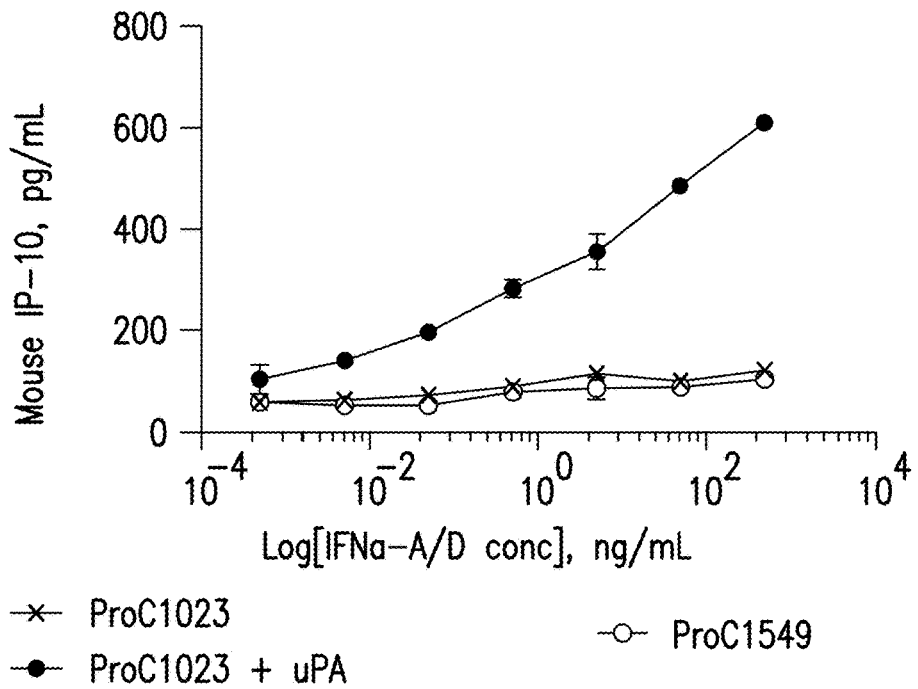
FIG. 21 shows in vitro activation of mouse splenocytes by IFNa-A/D (ProC1023) in compared to uPA-treated ProC1549 uncleavable masked construct.

As shown in FIG. 21, uPA-treated masked activatable IFNα A/D induced release of mouse splenocyte IP-10. Both control uncleavable IFNα A/D and masked activatable IFNα A/D without uPA treatment showed similar levels of IP-10 stimulation, which were well below the concentration of IP-10 detected for uPA-treated masked activatable IFNα A/D. The results in FIG. 21 show that stimulation of mouse splenocyte IP-10 release is conditionally dependent on activation of masked IFNα A/D.

Example 10: Effect of Masked IFN-α2b on In Vitro Hamster Cell Viability

Figure 22:
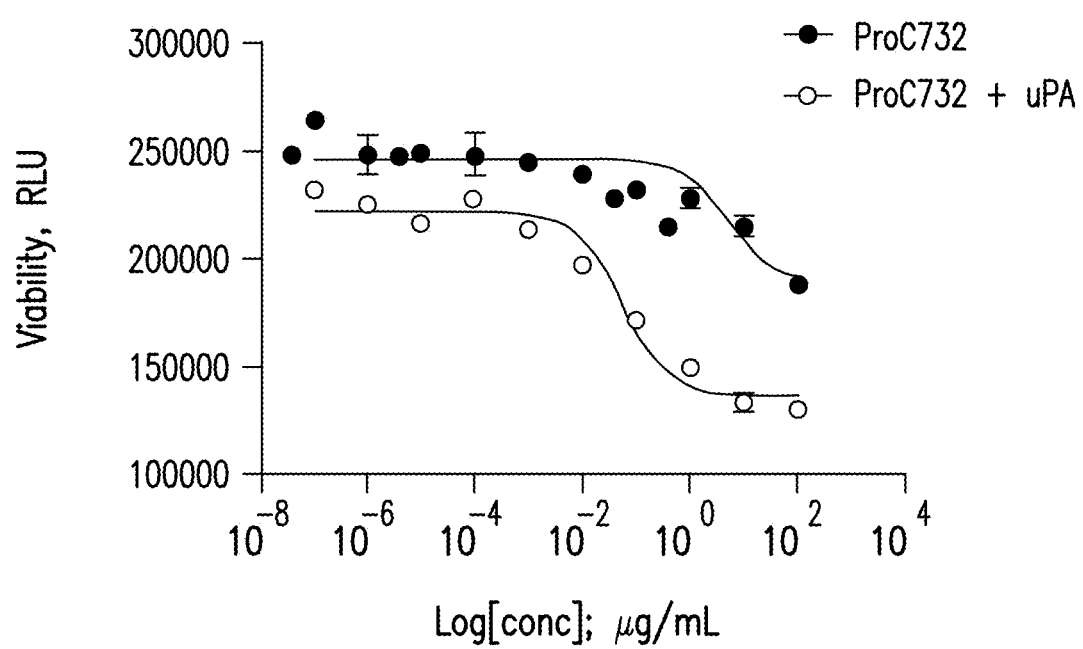
FIG. 22 shows the effects of masked IFN-a2b (ProC732) and ProC732 activated with uPA on hamster melanoma cell viability.

Cell viability of hamster melanoma RPMI1846 cells in response to treatment with masked activatable IFNα-2b ACC construct (ProC732) compared to treatment with ProC732 activated with uPA protease was assessed in vitro. RPMI1846 cells were treated with unmasked and masked ACC at increasing concentrations as shown in FIG. 22. The viability of RPMI1846 cells was determined using a Cell-Titer Glo assay (Promega, USA) according to standard assay protocol.

As shown in FIG. 22, hamster melanoma RPMI1846 cells were able to tolerate substantially higher doses of masked activatable ProC732 compared to unmasked ProC286. Mask moieties on ProC732 caused a substantial rightward shift in cell viability as a function of the cytokine construct concentration. These results demonstrate sensitivity of hamster cells to effects of human IFN-a2b and improved in vitro cell tolerability for ProC732.

ProC1301 (SEQ ID NO: 240) showed activation resistance to MMP14 and uPA. Hamster melanoma RPMI1846 cell viability was reduced upon activation of ProC732 with uPA (FIG. 22). The activation dependent reduction in cell viability was not observed in activation resistant ProC1301 (FIG. 35C).

Example 11: In Vivo Characterization of Conditionally Active INFa-A/D

Dual masked INFa-A/D ProC1023 and its modified version with potentially reduced cleavability ProC1549 were prepared as described in Example 1.

The antitumor activity of the masked IFNα-A/D was tested in vivo using the MC38 tumor model. Mice (N=5 per group) were implanted subcutaneously with 1.5×10$^6$ MC38 cells in serum-free medium. Body weights and tumor measurements were recorded twice weekly for the duration of the study. When the average tumor volume reached 80 mm$^3$, mice were dosed two times per week by subcutaneous injections of masked IFNa-A/D (ProC1023), or masked uncleavable IFNa-A/D (ProC1549) one time per week intraperitoneally at the indicated dose levels.

Figure 23A:
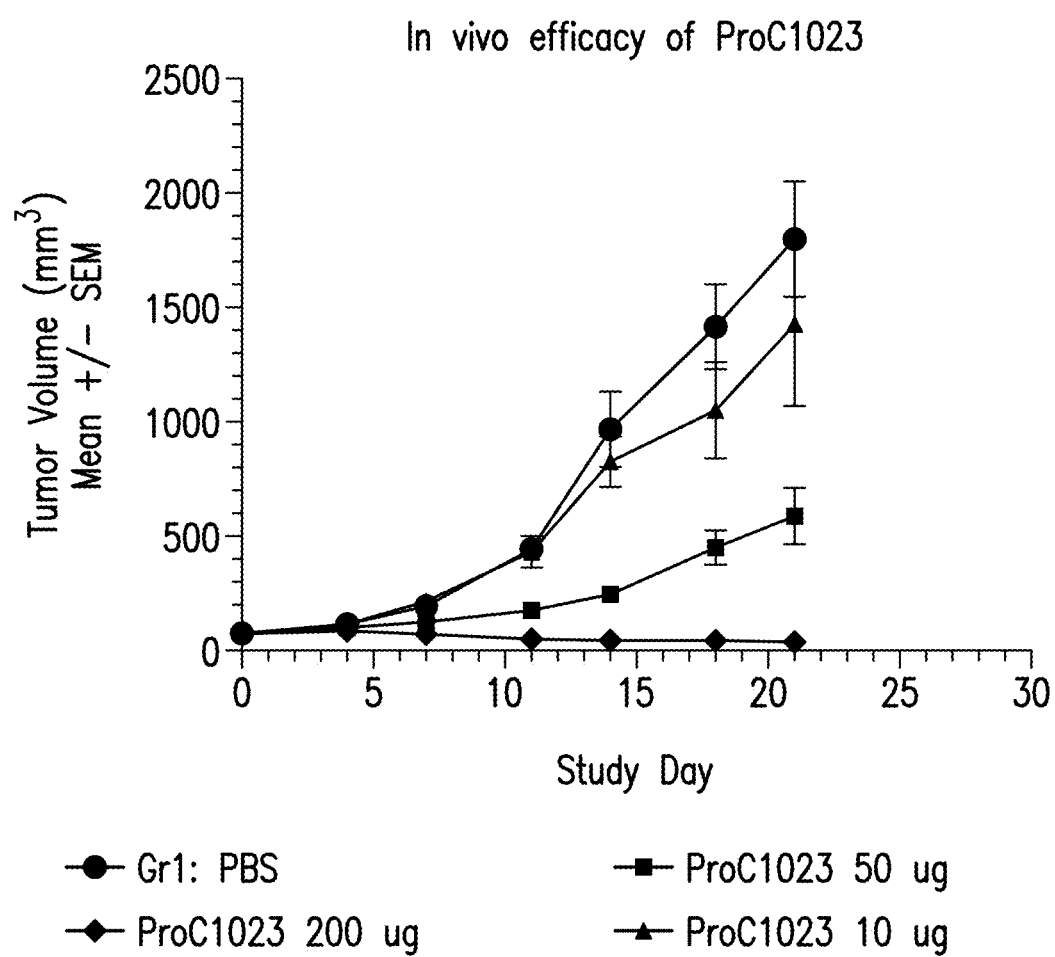
FIG. 23A shows anti-tumor activity of masked activatable IFNa A/D (ProC1023) at 10, 50, and 200 µg.
Figure 23B:
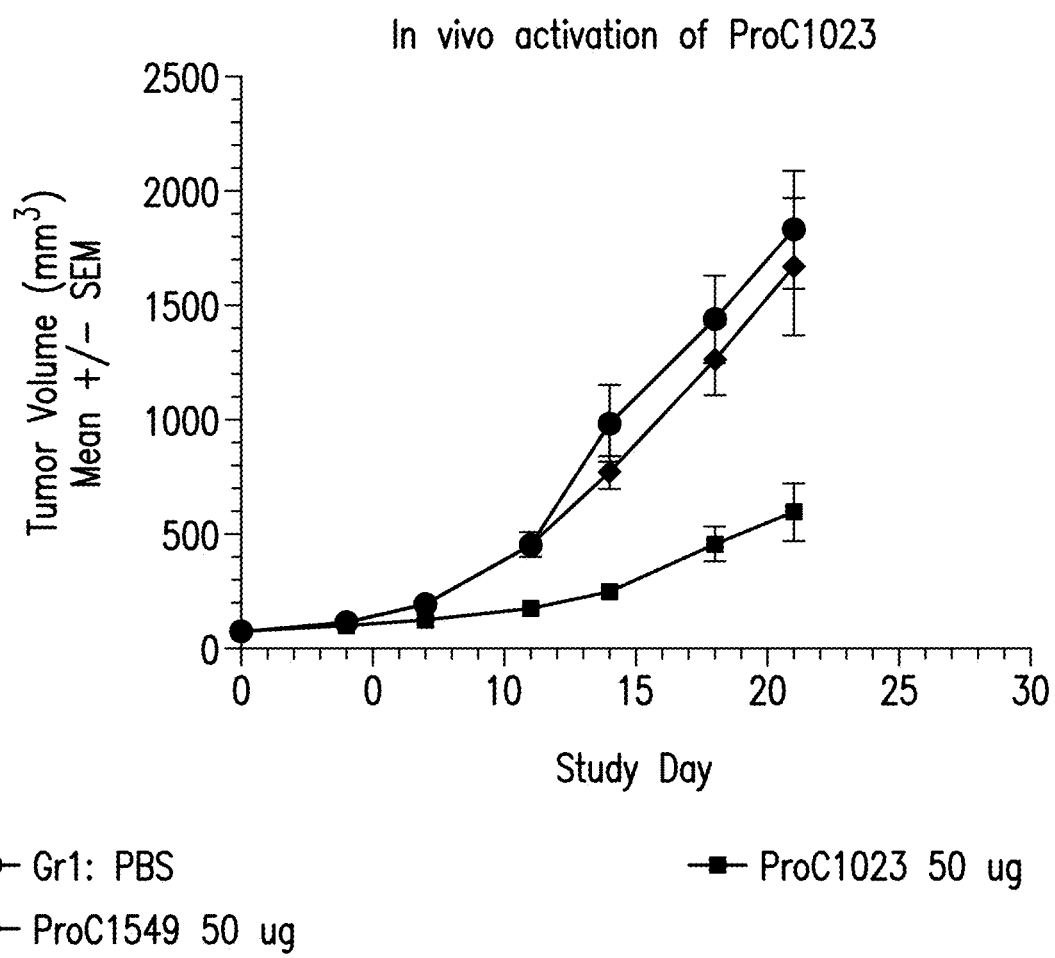
FIG. 23B shows in vivo activation of masked IFNa A/D relative (ProC1023) to an uncleavable masked IFNa A/D (ProC1549).

Masked IFNa-A/D demonstrated antitumor activity in the 50-200 ug dose level. Administration of 50 ug resulted in significant tumor growth inhibition, while administration of 200 ug also resulted in rejection of the tumors by 60% of the animals FIG. 23A. Antitumor effect of the masked IFNa-A/D (ProC1023) was dependent on proteolytic activation, because the uncleavable construct (ProC1549) did not mediate similar responses FIG. 23B.

Figure 32:
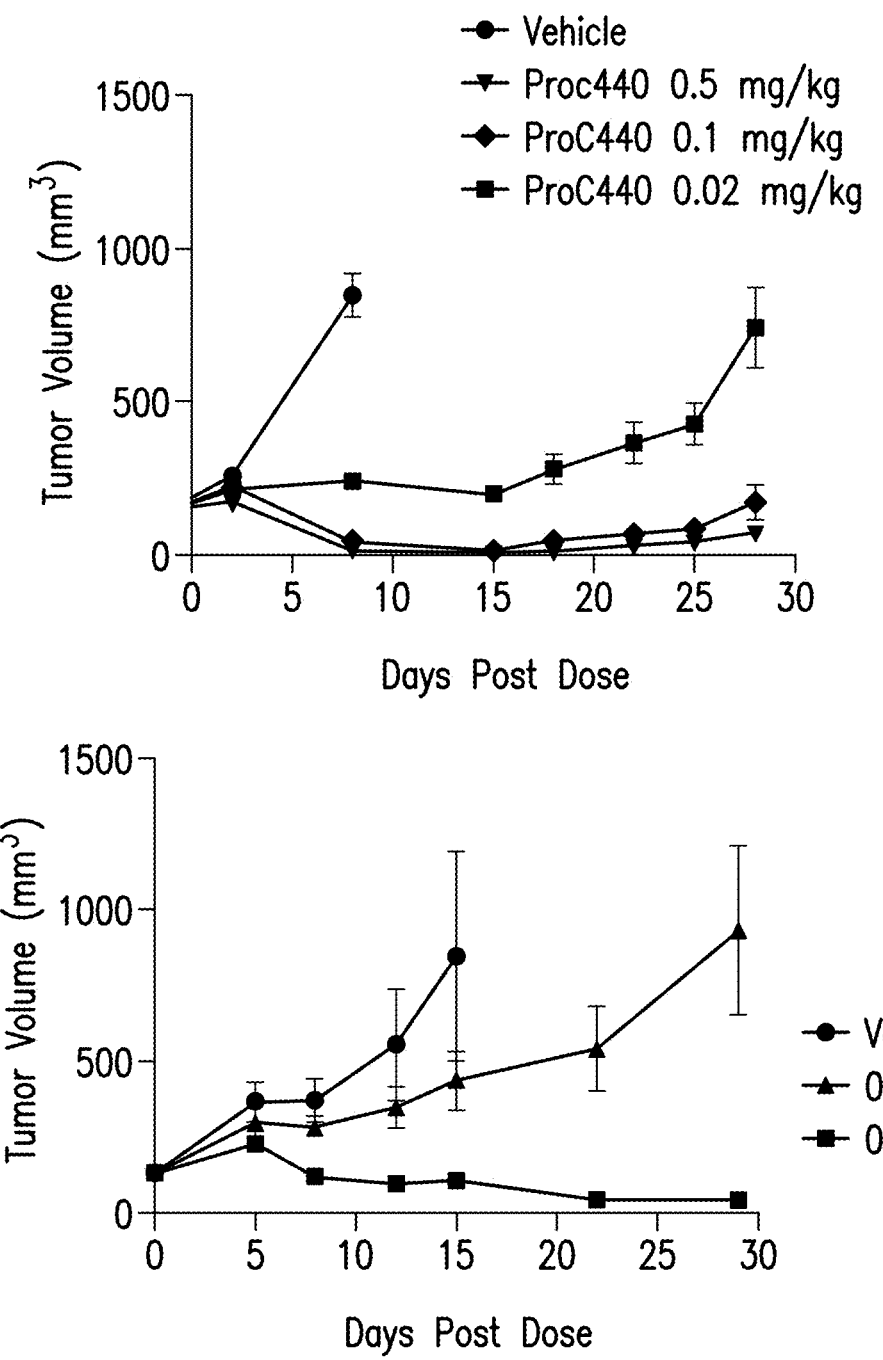
FIG. 32 shows anti-tumor activity of ProC440 (top) and peginterferon (bottom) at increasing doses.

Masked IFNa2b reduced tumor volume at increasing doses. Masked IFNa2b was prepared as described above. Masked IFNa2b/Fc prevented tumor progression at a dose of 0.02 mg/kg and induced tumor regression at a dose of 0.1 mg/kg (FIG. 32). As shown in FIG. 32, masked IFNa2b/Fc exhibited antitumor activity similar to peginterferon.

Figure 27:
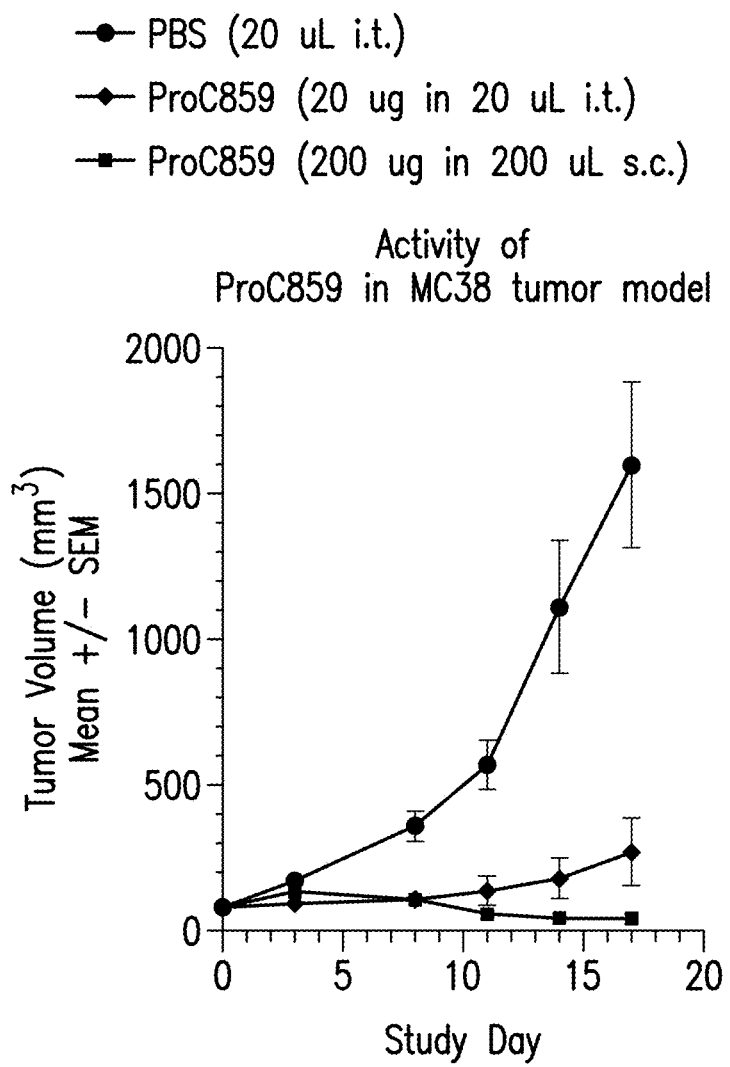
FIG. 27 shows anti-tumor activity of single masked activatable IFNa A/D (ProC859) at 20 µg intratumoral injection and 200 µg systemic administration compared to PBS control.

The antitumor activity of the masked IFNa-A/D was tested as described above with doses on days 1, 4, 8, 11, and 15. Tumor volume was assessed at times indicated in the graph of FIG. 27.

Figure 33:
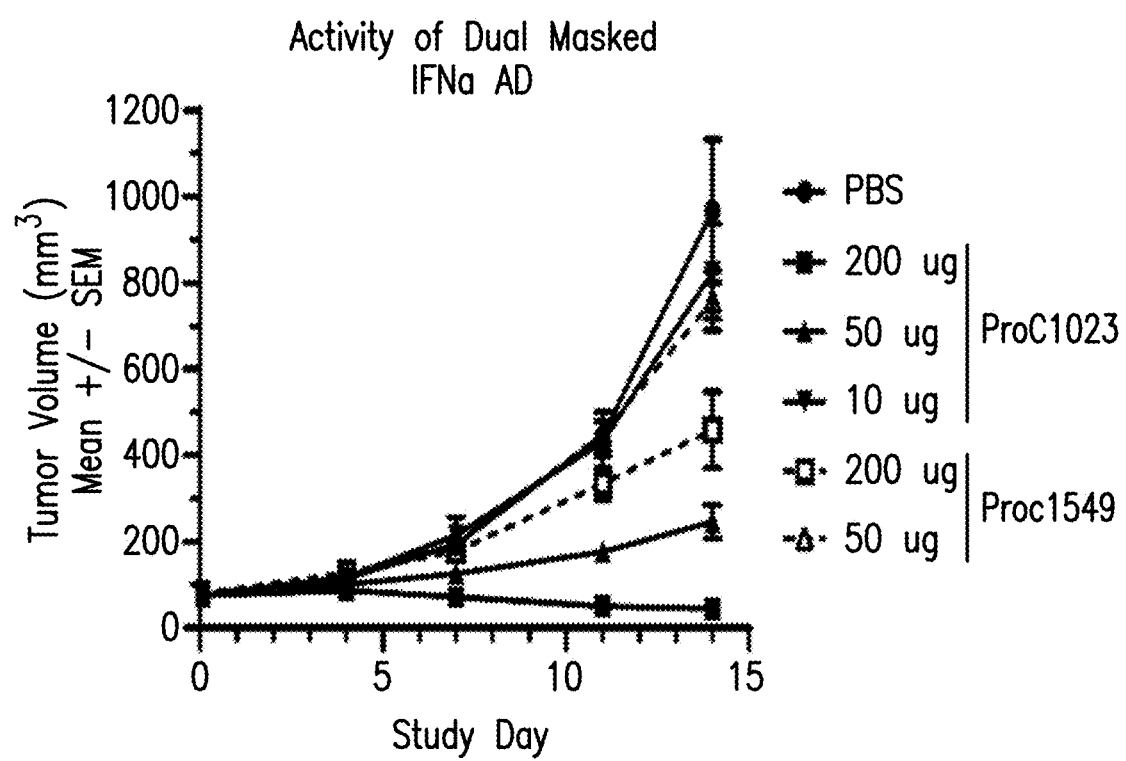
FIG. 33 shows anti-tumor activity of dual masked activatable IFNa A/D (ProC1023) compared to dual masked non-activatable IFNa A/D (ProC1549) at 10 µg, 50 µg, and 200 µg.

Additionally, masked IFNa2b showed anti-tumor activity at 20 µg and 200 µg compared to control (FIG. 33). The antitumor activity of the masked IFNa-A/D was tested as described above with doses on days 1, 4, 8, 11, and 15. Tumor volume was assessed at times indicated in the graph of FIG. 27.

As shown in FIG. 33, dual masked IFNα AD reduced tumor volume compared to a non-cleavable version at doses of 10, 50, and 200 μg (FIG. 33).

Figure 34A:
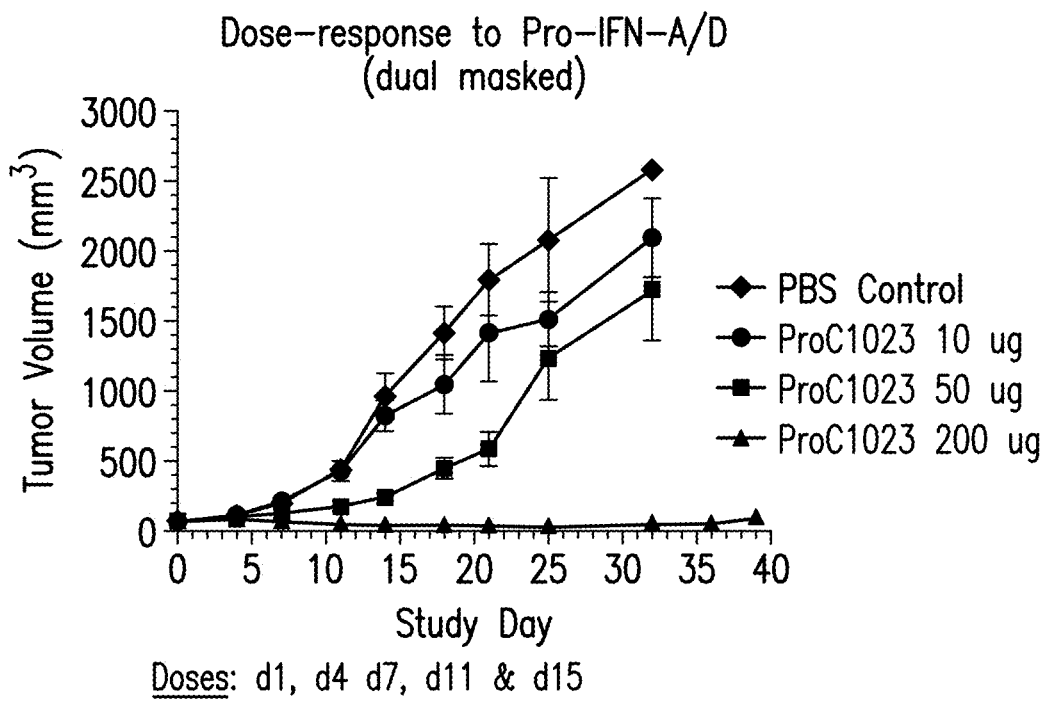
FIG. 34A shows anti-tumor activity of ProC1023 at 10, 50, and 200 µg compared to PBS control.
Figure 34B:
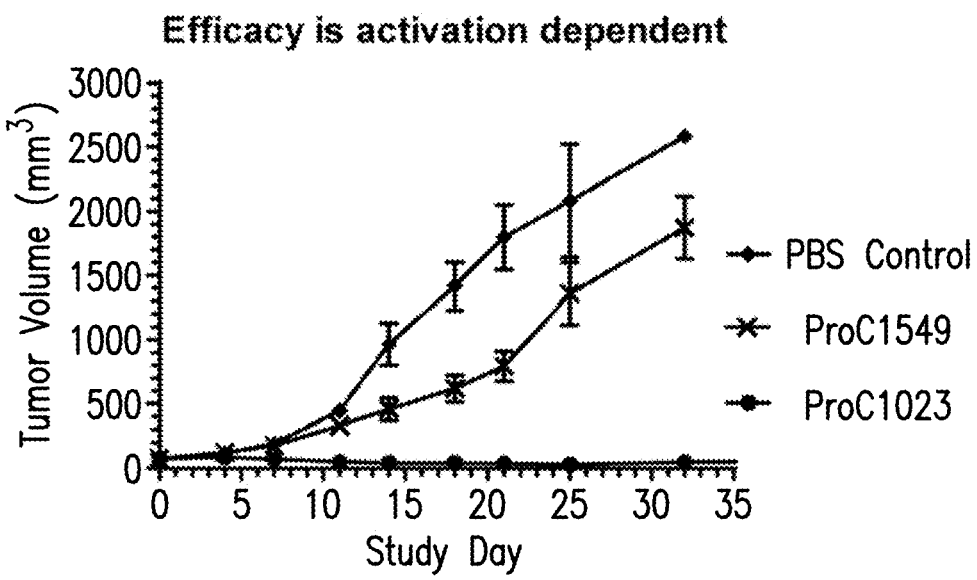
FIG. 34B shows anti-tumor activity of ProC1023 compared to non-activatable IFNa A/D (ProC1549) at 200 µg.

As shown in FIG. 34A, Pro IFNa A/D (ProC1023) inhibited tumor volume growth in a dose-dependent manner. The inhibition requires activation as shown in FIG. 34B, where IFNa A/D NSUB (ProC1549) at 200 μg showed reduced antitumor activity compared to Pro IFNa A/D (ProC1023) at the same dose.

Example 12. Immune Memory in IFNa-A/D Treated Mice

Figure 24A:
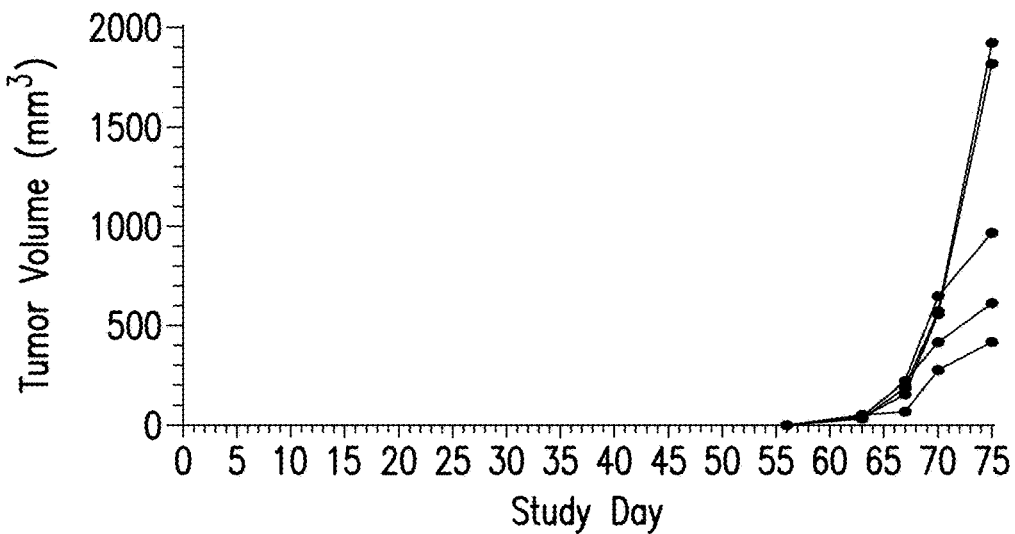
FIGS. 24A-24B show immune memory in response to MC38 tumor cell rechallenge in mice previously treated with activatable IFNa A/D (200 micrograms ProC1023) (bottom, FIG. 24B) compared to MC38 tumor cell challenge in naïve control mice (top, FIG. 24A).
Figure 24B:
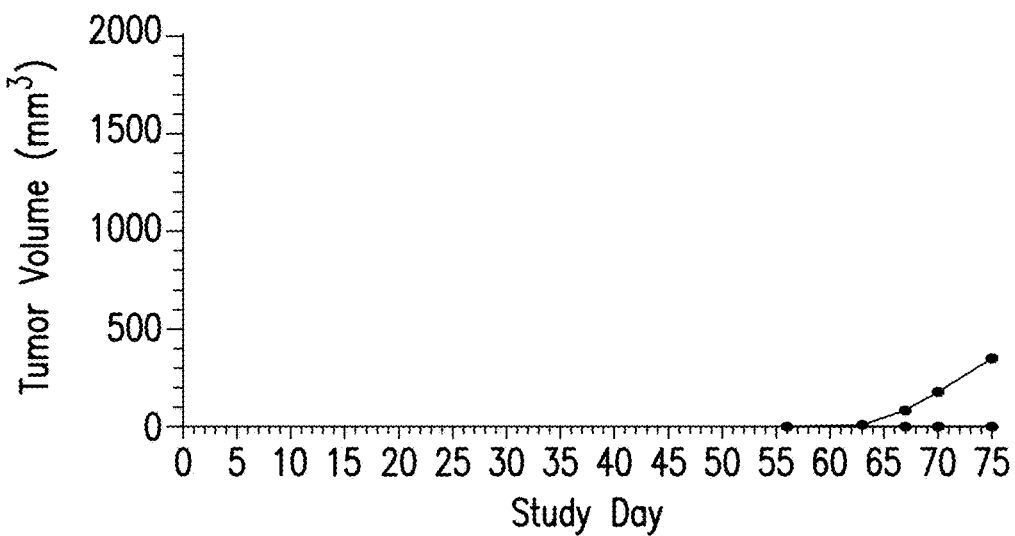

Naïve mice (N=5; FIG. 24A) or mice that rejected MC38 tumor after IFNα-A/D treatment with a 200 microgram dose of ProC1023 (N=3; FIG. 24B) were re-challenged with $1.5 \times 10^6$ MC38 cells at day 56 after initial treatment. Tumor growth was monitored twice weekly. Mice that rejected tumor after treatment with 200 ug/dose IFNa-A/D were re-challenged with MC38 tumor 56 days after the initial treatment. The mice were not administered any treatment during the re-challenge period. After the challenge, MC38 tumors progressively grew in all five control animals (FIG. 24A), however only one out of three previously IFNa-A/D-treated mice developed the tumor, and the tumor in that mouse exhibited significantly slower growth consistent with the formation of antitumor immune memory in these mice that had been previously treated the 200 micrograms dose of ProC1023 (FIG. 24B).

The results indicate that masked IFNa-A/D suppresses MC38 tumor growth in activation-dependent, immune mediated manner.

Example 13: Activation-Dependent Induction of Type I Interferon Signature by Unmasked IFN-a2b Dual masked INFa-a2b (SEQ ID NO: 321, ProC732) was activated by treatment with uPA as described previously. Pegylated IFN-a2b (Merck, USA) was purchased from a vendor.

PBMCs from four healthy donors were purchased from a vendor as a cryopreserved, single-cell suspensions with at least 80% viability after thawing. PBMCs from each donor were treated in vitro with 1 ug/mL (high dose) of masked IFN-a2b (uncleaved ProC732), or 10 ng/mL of masked IFN-a2b (uncleaved ProC732), unmasked IFN-a2b (uPA-treated ProC732), or Peg-IFN-a2b (Sylatron®-Merck, USA) for 24 hours. Bulk mRNA from treated cells was subjected to paired-end 150c RNAseq high-throughput sequencing. Unique gene hit counts were calculated by using Subread package v.1.5.2. Using DESeq2, a comparison of gene expression between the indicated groups of samples was performed. The Wald test was used to generate p-values and log 2 fold changes. Genes with an adjusted p-value <0.05 and absolute log 2 fold change>1 were called as differentially expressed genes for each comparison.

TABLE 9

Pair-wise comparison of gene expression profiles

| | Untreated | ProC732 | ProC732 high dose | ProC732 + uPA | Sylatron (Peg-IFN-a2b) |
|---|---|---|---|---|---|
| Untreated | | ↑ 1 | ↑ 248 | ↑ 418 | ↑ 480 |
| | | ↓ 0 | ↓ 36 | ↓ 77 | ↓ 86 |
| ProC732 | | | ↑ 8 | ↑ 71 | ↑ 125 |
| | | | ↓ 1 | ↓ 10 | ↓ 17 |
| ProC732 high dose | | | | ↑ 1 | ↑ 0 |
| | | | | ↓ 0 | ↓ 0 |
| ProC732 + uPA | | | | | ↑ 0 |
| | | | | | ↓ 0 |

Figure 25:
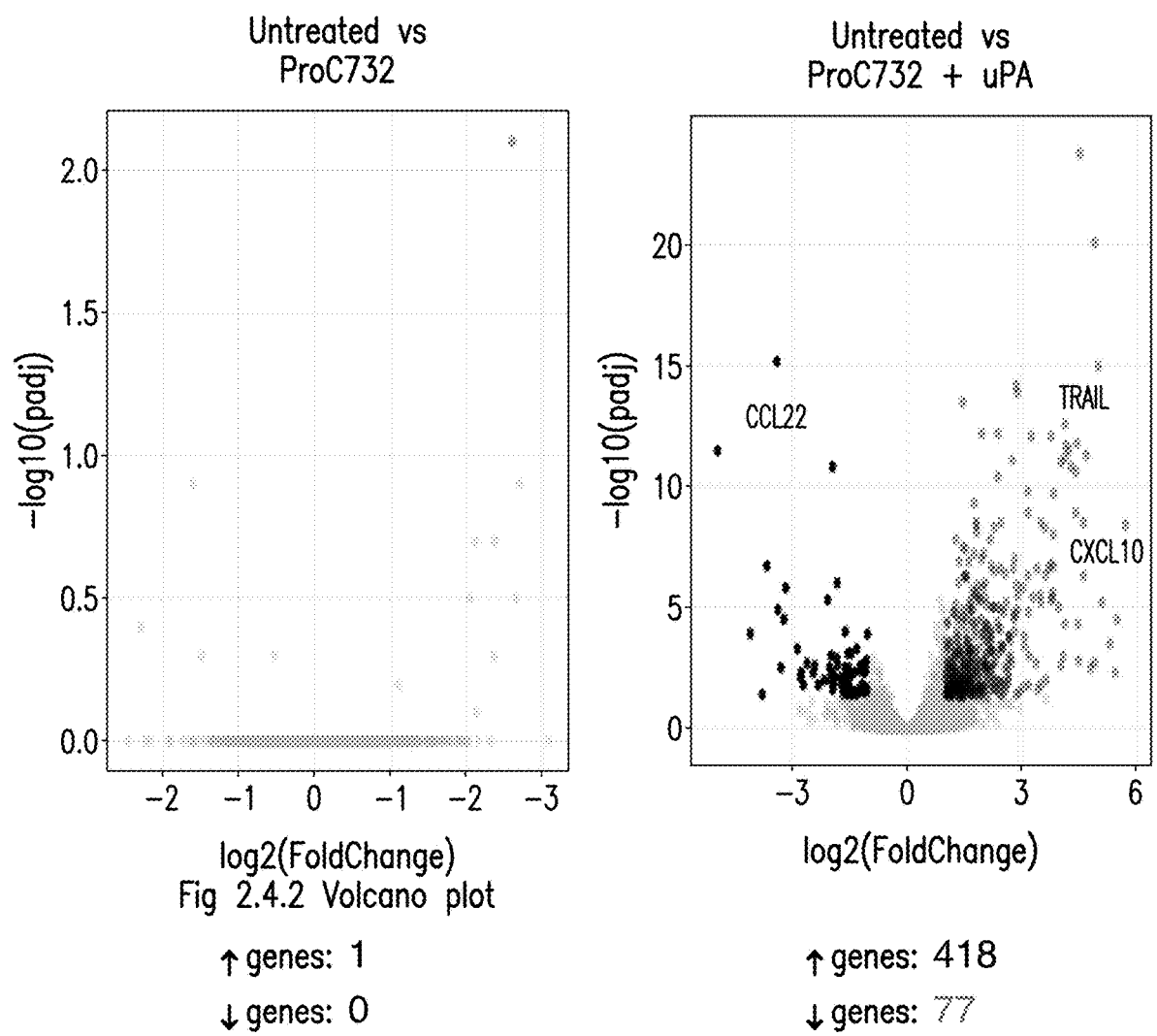
FIG. 25 shows activation-dependent induction of type I interferon signature comparisons using masked Pro-IFN-a2b (uncleaved ProC732), unmasked IFN-a2b (uPA-treated ProC732), or Peg-IFN-a2b (Sylatron®).
Figure 25:
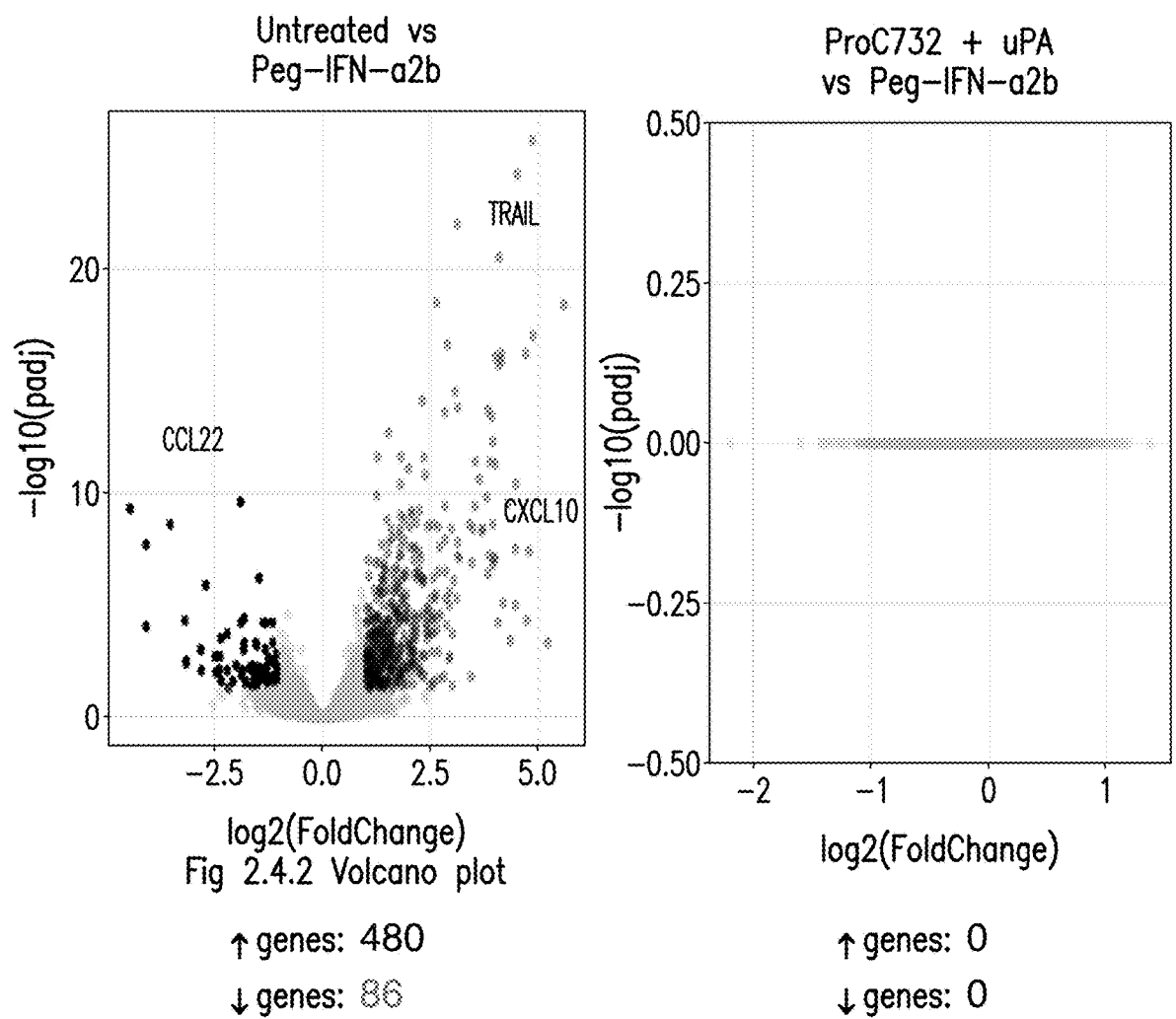

Treatment of PBMCs with masked IFN-a2b did not result in gene expression changes, while activated IFN-a2b consistently upregulated and downregulated large number of genes in all four donors (FIG. 25). The results demonstrate statistically significant increases in the expression of 418 genes, whereas 77 genes were downregulated (Table 9). Gene ontology analysis revealed a pattern associated with activation of type I interferon signaling, including enhanced expression of known targets of IFN-a2b such as CXCL10, TRAIL and 2'OAS. Treatment with pegylated IFN-a2b induced and suppressed similar number of genes in all donors. Direct comparison between expression profile of PBMC treated with activated IFN-a2b and Peg-IFN-a2b revealed no difference between two treatments.

The results are consistent with activation dependent induction of interferon signaling in primary human immune cells by unmasked IFN-a2b. Minimal changes between gene expression induced by high dose of masked IFN-a2b and the unmasked interferon indicate that dual masking reduced signaling potential of the cytokine without creating new interactions with the receptor.

Example 14: Pharmacokinetic Properties of Masked IFN-a2b

Dual masked INFa-a2b (ProC732), steric masked IFN-a2b (SEQ ID NO: 316, ProC440), its uncleavable control (ProC659), or Fc-IFN-a2b fusion molecule (ProC286) were administered to golden Syrian hamsters as described previously. Blood samples were obtained at 6, 24, 72 hours or 7 days after administration. Concentrations of IFN-a2b were measured using ELISA (Mabtech, USA). Non-compartmental pharmacokinetic analysis was performed using WinNonlin software (Certara, USA).

Figure 26:
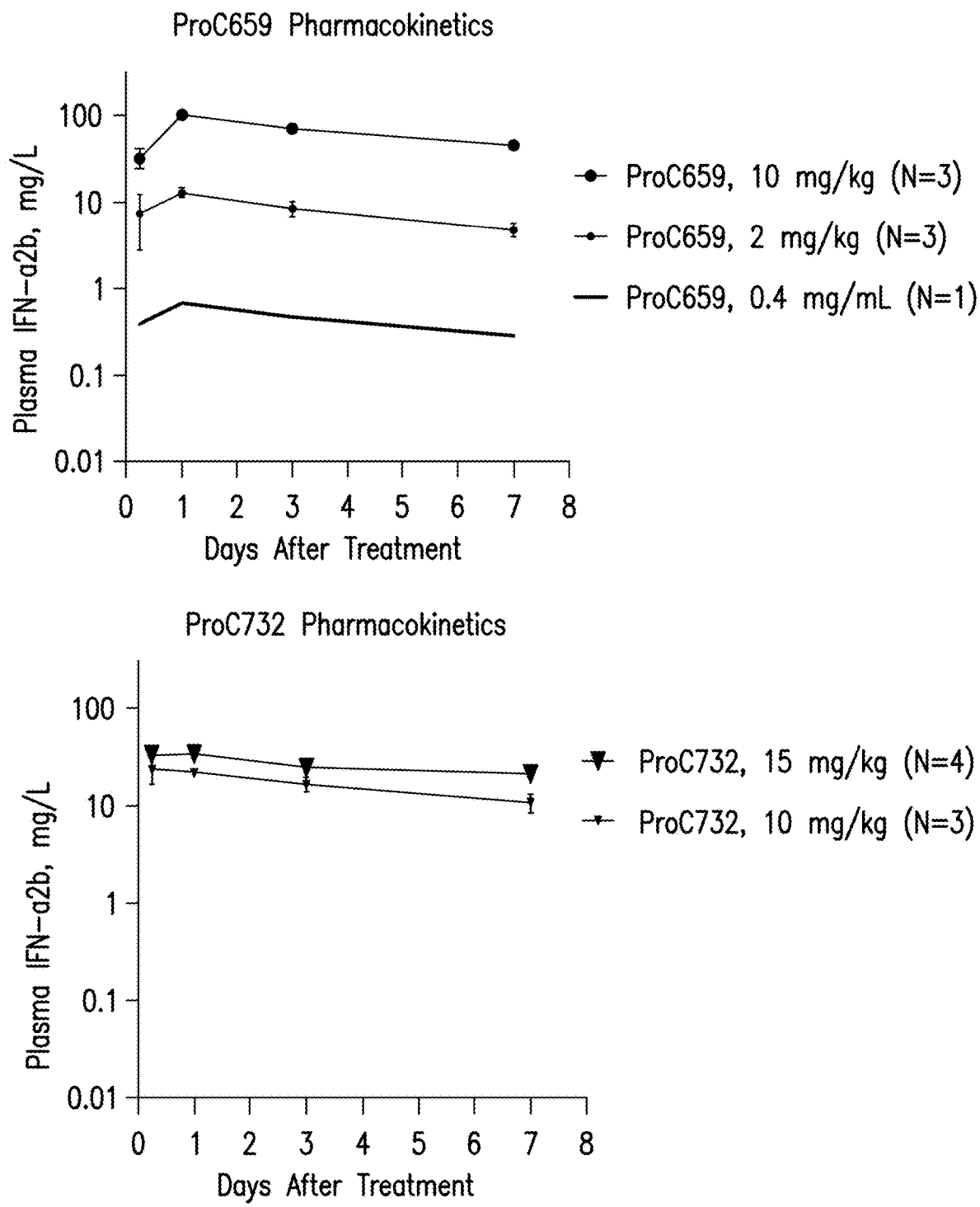
FIG. 26 shows pharmacokinetics of the dual masked INF-a2b (ProC732) and ProC286, ProC440, and ProC659 in hamsters.

Pharmacokinetic profiles of all tested molecules demonstrate increased serum concentrations proportional to the administered dose (FIG. 26). At each dose level, drug exposure was comparable between masked IFN-a2b and control proteins. Non-compartmental analysis revealed average circulation half-life of 4.3 days—ranging 1.98 to 6.38 days (Table 10).

The results indicate linear pharmacokinetic properties of IFN-a2b in vivo and extended half-life compared to published data for unmodified IFN-a2b (2.3 hours) and Peg-IFN-a2b conjugated with a 12 kDa PEG molecule (4.3 hours).

Pharmacokinetics profiles of all tested molecules indicate increased serum concentrations proportional to the administered dosages.

TABLE 10

Summary of non-compartmental analysis of IFN-a2b pharmacokinetics

| Test_Article | Dose mg/kg | Tmax day | Cmax ng/mL | AUClast day*ng/mL | HL_Lambda_z (half life) day |
|---|---|---|---|---|---|
| ProC286 | 0.4 | 0.25 | 2913 | 10371 | 4.3499 |
| ProC286 | 2 | 1 | 8225 | 30936 | |
| ProC286 | 2 | 1 | 8863 | 39595 | |
| ProC286 | 2 | 1 | 7685 | 29731 | |
| ProC286 | 10 | 3 | 19443 | 104368 | |
| ProC286 | 10 | 1 | 37673 | 79286 | |
| ProC286 | 10 | 1 | 24036 | 118866 | |
| ProC286 | 15 | 0.25 | 41340 | 187894 | 1.9774 |
| ProC286 | 15 | 1 | 63075 | 250384 | |
| ProC286 | 15 | 1 | 74989 | 259900 | |
| ProC286 | 15 | 3 | 45546 | 219676 | |
| ProC440 | 0.4 | 1 | 401 | 1791 | 4.3952 |
| ProC440 | 2 | 1 | 4718 | 18986 | |
| ProC440 | 2 | 1 | 7137 | 27274 | |
| ProC440 | 2 | 1 | 8968 | 40329 | |
| ProC440 | 10 | 1 | 36860 | 161885 | |
| ProC440 | 10 | 1 | 31851 | 152170 | |
| ProC440 | 15 | 0.25 | 53422 | 214393 | 5.1186 |
| ProC440 | 15 | 1 | 44331 | 226428 | |
| ProC440 | 15 | 0.25 | 37551 | 122954 | 4.5772 |
| ProC440 | 15 | 1 | 18738 | 109485 | |
| ProC659 | 0.4 | 1 | 686 | 3143 | 5.0481 |
| ProC659 | 2 | 3 | 9842 | 48705 | |
| ProC659 | 2 | 0.25 | 12284 | 44567 | |
| ProC659 | 2 | 0.25 | 15715 | 36674 | 5.7591 |
| ProC659 | 10 | 1 | 51601 | 303538 | |
| ProC659 | 10 | 1 | 57389 | 315392 | |
| ProC659 | 10 | 1 | 51022 | 241447 | |
| ProC732 | 10 | 1 | 21019 | 128288 | |
| ProC732 | 10 | 1 | 34498 | 182458 | |
| ProC732 | 10 | 1 | 34191 | 179881 | |
| ProC732 | 15 | 0.25 | 33121 | 186676 | 6.3841 |
| ProC732 | 15 | 1 | 54723 | 164326 | |
| ProC732 | 15 | 1 | 27760 | 157575 | |
| ProC732 | 15 | 1 | 33898 | 177802 | |

Unmasked, single and dual masked IFNa2b, and NSUB control IFNa2b were administered to golden Syrian hamsters as described previously. Blood samples were obtained at 6, 24, 72 hours or 7 days after administration. Concentrations of IFNa2b were measured using ELISA (Mabtech, USA).

Pharmacokinetic profiles of all tested molecules demonstrate increased concentrations proportional to the administered dose (FIG. 26).

Example 15: In Vitro Characterization of Example Universal Cytokine Constructs

A universal activatable cytokine construct was prepared by recombinant methods described herein. The universal ACC has a universal interferon sequence (ProC1023) having activity on both human and mouse cells. The universal ACC is a dimer. The 1$^{st}$ and 2$^{nd}$ monomer constructs of this ACC were identical, with each being a polypeptide having the amino acid sequence of SEQ ID NO: 235 with a signal sequence at its N-terminus. Each of the 1$^{st}$ and 2$^{nd}$ monomer constructs comprises, from N-terminus to C-terminus a signal sequence, a spacer (QSGQ) sequence (SEQ ID NO: 256), an IFNalpha-2b masking peptide (TDVDYYREWS-WTQVS) (SEQ ID NO: 323), a linker (GSSGGS) (SEQ ID NO: 324), a cleavable moiety having the amino acid sequence (LSGRSDNI) (SEQ ID NO: 41), a linker ((GS)n, (GGS)n, (GSGGS)n (SEQ ID NO: 227), wherein n=1), a mature cytokine protein that corresponds to a universal interferon molecule that is a hybrid of IFN alpha 1 and IFN alpha 2a (SEQ ID NO: 481), a cleavable moiety having the amino acid sequence (LSGRSDNI) (SEQ ID NO: 41), and a DD corresponding to human IgG4 S228P Fc, truncated to Cys226 (according to EU numbering) (SEQ ID NO: 3).

Another universal cytokine construct, ProC1549, was prepared by recombinant methods. The 1$^{st}$ and 2$^{nd}$ monomer constructs of this ACC were identical, with each being a polypeptide having the amino acid sequence of ProC1549 (having an exemplary optional signal sequence). Each of the 1$^{st}$ and 2$^{nd}$ monomer constructs comprises, from N-terminus to C-terminus, a signal sequence, a spacer (e.g., QSGQ) sequence, an IFNalpha-2b masking peptide (TDVDYYREWSWTQVS) (SEQ ID NO: 323), a linker (GSSGGS) (SEQ ID NO: 324), a non-cleavable moiety having the amino acid sequence of SEQ ID NO: 211, a linker ((GS)n, (GGS)n, (GSGGS)n (SEQ ID NO: 227), wherein n=1), a mature cytokine protein that corresponds to a universal interferon molecule that is a hybrid of IFN alpha 1 and IFN alpha 2a (SEQ ID NO: 481), a non-cleavable moiety having the amino acid sequence (GGSGGGGS) (SEQ ID NO: 501), and a DD corresponding to human IgG4 S228P Fc, including the full hinge sequence (SEQ ID NO: 3). Because the ProC1549 construct lacks cleavable moieties between the masking peptide and the cytokine, as well between the cytokine sequence and the DD, it is not activatable, as discussed below.

Another universal activatable cytokine construct, ProC859, was prepared by recombinant methods described herein. ProC859 has a universal interferon sequence having activity on both human and mouse cells. ProC859 is a dimer. The 1$^{st}$ and 2$^{nd}$ monomer constructs of this ProC859 were identical, with each being a polypeptide having the amino acid sequence of ProC859 with a signal sequence at its N-terminus. Each of the 1$^{st}$ and 2$^{nd}$ monomer constructs comprises, from N-terminus to C-terminus, a signal sequence, a mature cytokine protein that corresponds to a universal interferon molecule that is a hybrid of IFN alpha 1 and IFN alpha 2a (SEQ ID NO: 481), a cleavable moiety having the amino acid sequence (SGRSDNI) (SEQ ID NO: 100), and a dimerization domain corresponding to human IgG Fc (SEQ ID NO: 3). Unlike ProC1023, ProC859 does not comprise a peptide masking moiety.

Figure 28A:
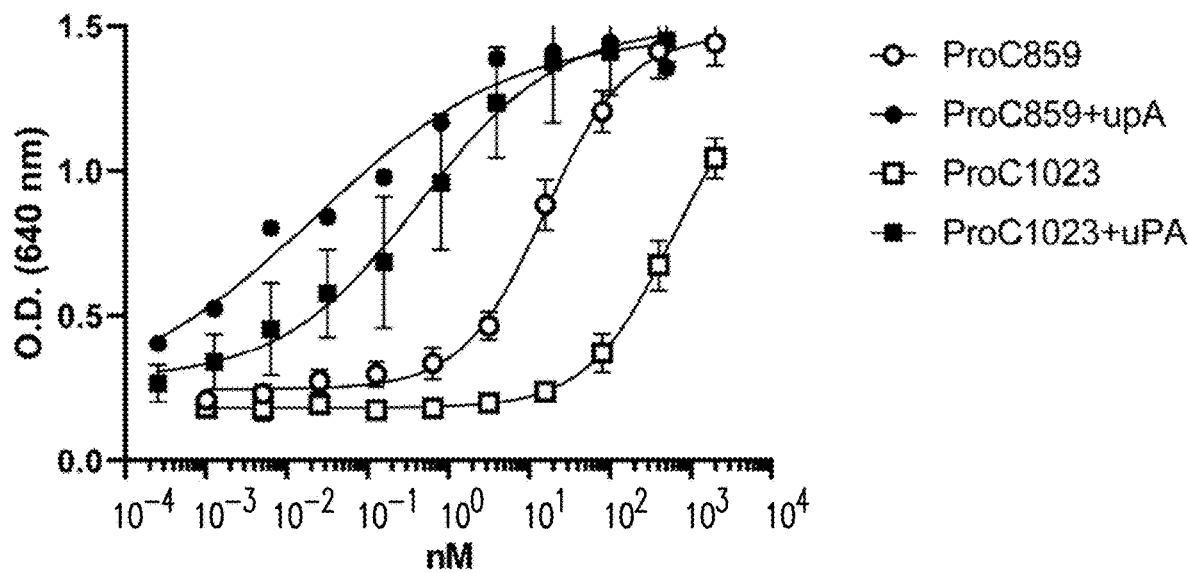
FIG. 28A shows the activity of dual masked ProC1023 compared to single masked ProC859 in an IFNa reporter assay in B16 mouse melanoma cells.

The activity of the universal cytokine constructs ProC1023 and proC859 was tested in vitro using B16 mouse melanoma cells. The activity of ProC1023 was further reduced as compared to ProC859 (FIG. 28A). This indicates that the addition of a peptide mask provided additional masking strength even though the cytokine activity was already significantly reduced in ProC859 by steric masking through the dimerization domains. Surprisingly, it appears that the addition of a masking peptide (PM) does not interfere with steric masking by the DD, nor does the DD appear to interfere with masking by the PM. Protease activation with uPa restored the activity of ProC1023 to a level comparable to the level of ProC859 after protease activation with uPa. This indicates that ProC1023, upon protease activation, recovered the full strength of activity of an unmasked universal IFNalpha.

Figure 28B:
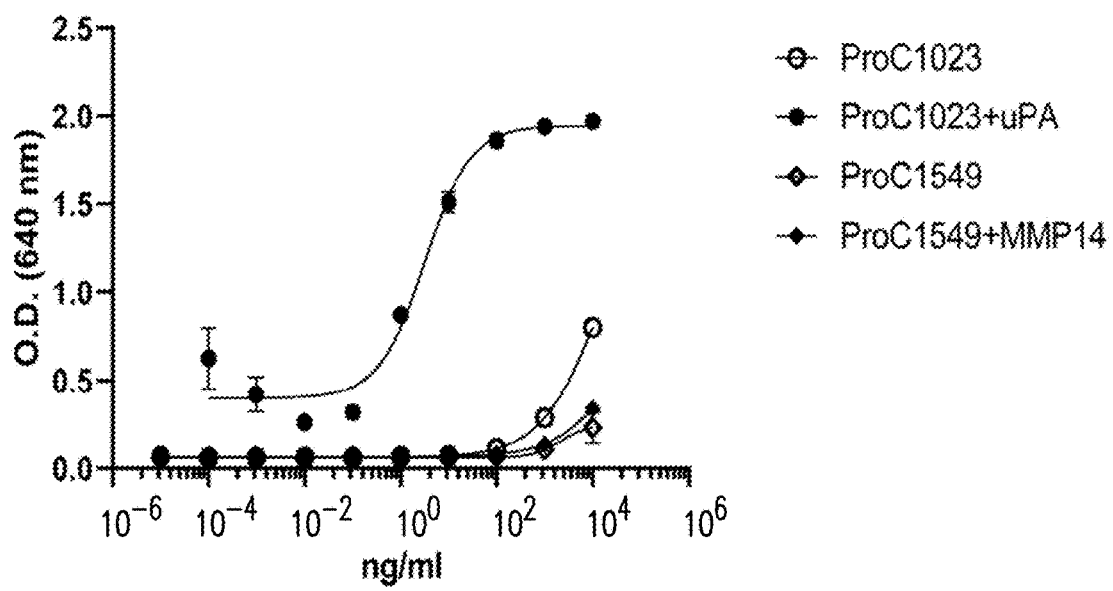
FIGS. 28B and 28C show the activity of ProC1023 compared to ProC1549 in an IFNa reporter assay in B16 mouse melanoma cells.
Figure 28C:
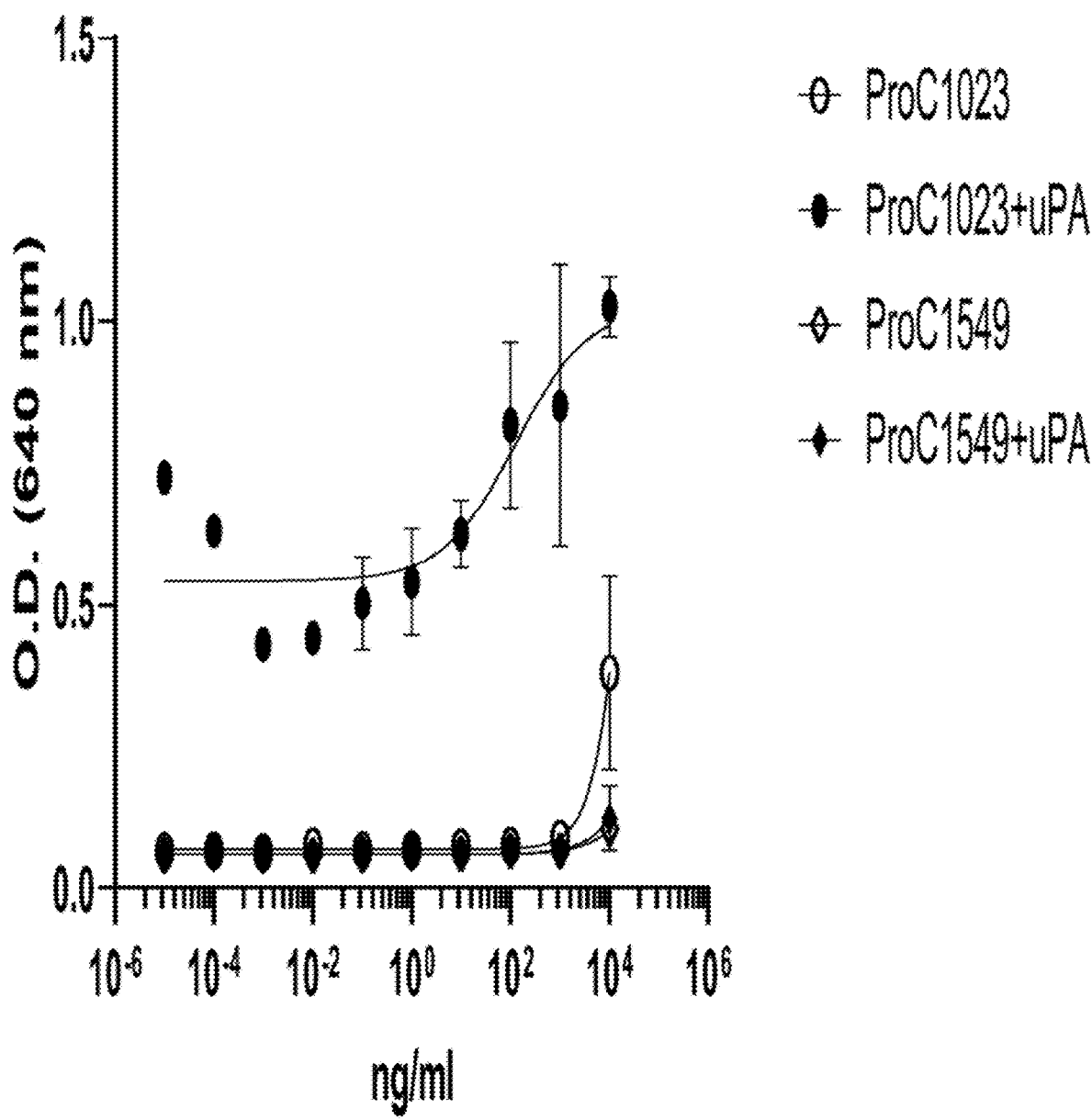

The masking efficiencies of ACCs in a HEK reporter assay (as measured by comparing the EC50 of the uncleaved ACC to the EC50 of the cleaved ACC) were as follows:
ProC1023: 1387X
ProC859: 700X The activity of the universal cytokine constructs ProC1023 and ProC1549 was tested in vitro using B16 mouse melanoma cells. In the un-activated state, ProC1023 and ProC1549 showed similar reduction of signaling activity (FIGS. 28B and 28C). Upon Protease activation with either uPa or MMP14, activity of the non-cleavable ProC1549 remains low and similar to ProC1549 without protease activation, while activity of ProC1023 was significantly increased after protease activation as compare ProC1023 and ProC1549 without protease activation (FIGS. 28B and 28C). This indicates that ProC1549 is resistant to Protease activation, and it can be used as a control to demonstrate protease-dependent activation of universal activatable cytokine constructs.

Example 16: In Vitro Characterization of Additional Heterodimeric ACCs

ACC ProC1239 (Pro-IFN 49CS 1204 IFNa2b 0 1204 0 G4 Knob Stub Hole) was also prepared by recombinant methods. The 1st monomer construct of this ACC is a polypeptide having the amino acid sequence of ProC1239 Arm 1 and a signal sequence at its N-terminus. The 1st monomer construct of this ACC comprises, from N-terminus to C-terminus a signal sequence, a spacer (QSGQ) sequence (SEQ ID NO: 256), an IFNalpha-2b masking peptide (TDVDYYREWSWTQVS) (SEQ ID NO: 323), a linker (GSSGGS) (SEQ ID NO: 324), a cleavable moiety having the amino acid sequence (LSGRSDNI) (SEQ ID NO: 41), a linker ((GS)n, (GGS)n, (GSGGS)n (SEQ ID NO: 227), wherein n=1), a mature cytokine protein that corresponds to human interferon alpha-2b (SEQ ID NO:1), a cleavable moiety having the amino acid sequence (LSGRSDNI) (SEQ ID NO: 41), and a DD corresponding to human IgG Fc with a knob mutation, truncated to Cys226 (according to EU numbering) (SEQ ID NO: 318). The 2nd monomer construct of this ACC is a polypeptide having the amino acid sequence of ProC1239 Arm 2 and a signal sequence at its N-terminus. The 2nd monomer construct has, from N-terminus to C-terminus, a signal sequence, a stub moiety (SDNI) (SEQ ID NO: 320), and a dimerization domain corresponding to human IgG Fc with a hole mutation (SEQ ID NO: 319).

The activity of ProC1239 and ProC732 was tested in vitro using IFN-responsive HEK293 cells as previously described. The activity of ProC1239 was moderately reduced as compared to ProC732 (FIG. 29).

Example 17: In Vitro Characterization of Additional ACCs with Various Cleavable Linkers Additional activatable cytokine constructs with varying cleavable linker were also prepared by recombinant methods. The 1st and 2nd monomer constructs of these ACCs were identical. Each of the 1st and 2nd monomer constructs comprises, from N-terminus to C-terminus, a signal sequence, a spacer (QSGQ) sequence (SEQ ID NO: 256), an IFNalpha-2b masking peptide (TDVDYYREWSWTQVS) (SEQ ID NO: 323), a linker (GSSGGS) (SEQ ID NO: 324), a cleavable moiety, a linker ((GS)n, (GGS)n, (GSGGS)n (SEQ ID NO: 227), wherein n=1), a mature cytokine protein that corresponds to human interferon alpha-2b (SEQ ID NO: 1), a cleavable moiety, and a DD corresponding to human IgG4 S228P Fc, truncated to Cys226 (according to EU numbering) (SEQ ID NO: 3). The various cleavable linkers used in the ACCs are described in the following table:

Activable cytokines having different cleavable linkers between

| Name | Alternative Name | CM between CP and PM | CM between CP and DD |
|---|---|---|---|
| ProC732 | Pro-IFN 49CS 1204 IFNa2b0 1204 0 (-ESKYGPP (SEQ ID NO: 317)) G4 | LSGRSDNI (SEQ ID NO: 41) | LSGRSDNI (SEQ ID NO: 41) |
| ProC1550 | Pro-IFN 49CS 1205 IFNa2b0 1205 0 (-ESKYGPP (SEQ ID NO: 317)) G4 | LSGRSNI (SEQ ID NO: 315) | LSGRSNI (SEQ ID NO: 315) |
| ProC1552 | Pro-IFN 49CS 559 IFNa2b0 559 0 (-ESKYGPP (SEQ ID NO: 317)) G4 | QNQALRMA (SEQ ID NO: 16) | QNQALRMA (SEQ ID NO: 16) |

Figure 30:
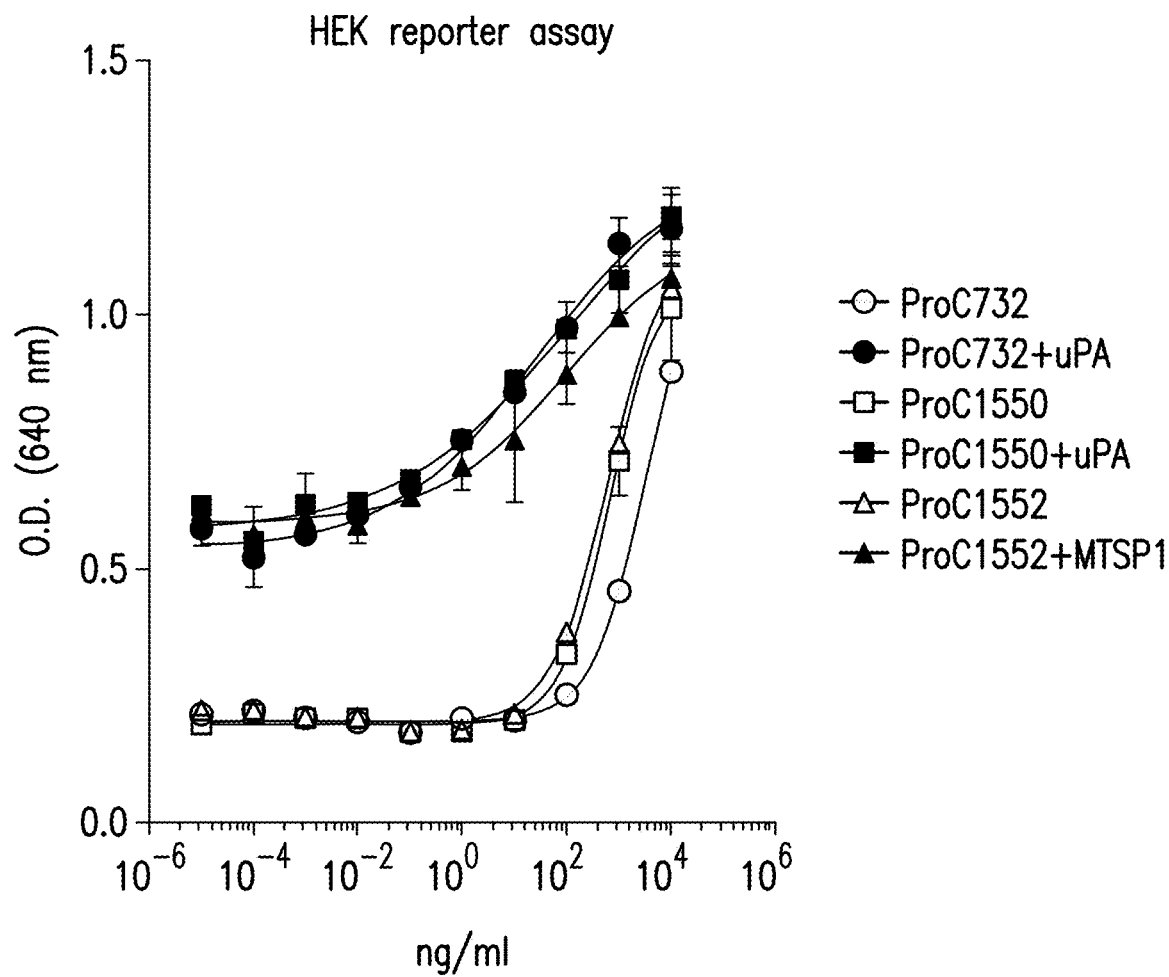
FIG. 30 shows the activity of ProC732, ProC1550 and ProC1552 tested in vitro using IFN-responsive HEK293 cells in an uncleaved state and after protease activation with either uPa or MTSP1.

The activity of ProC732, ProC1550 and ProC1552 were tested in vitro using IFN-responsive HEK293 cells as previously described. Upon protease activation with either uPa or MTSP1, all activable cytokine constructs showed a similar increased of activity, indicating that all activated cytokines constructs recover the same level of activity upon protease treatment as shown in FIG. 30.

Figure 41A:
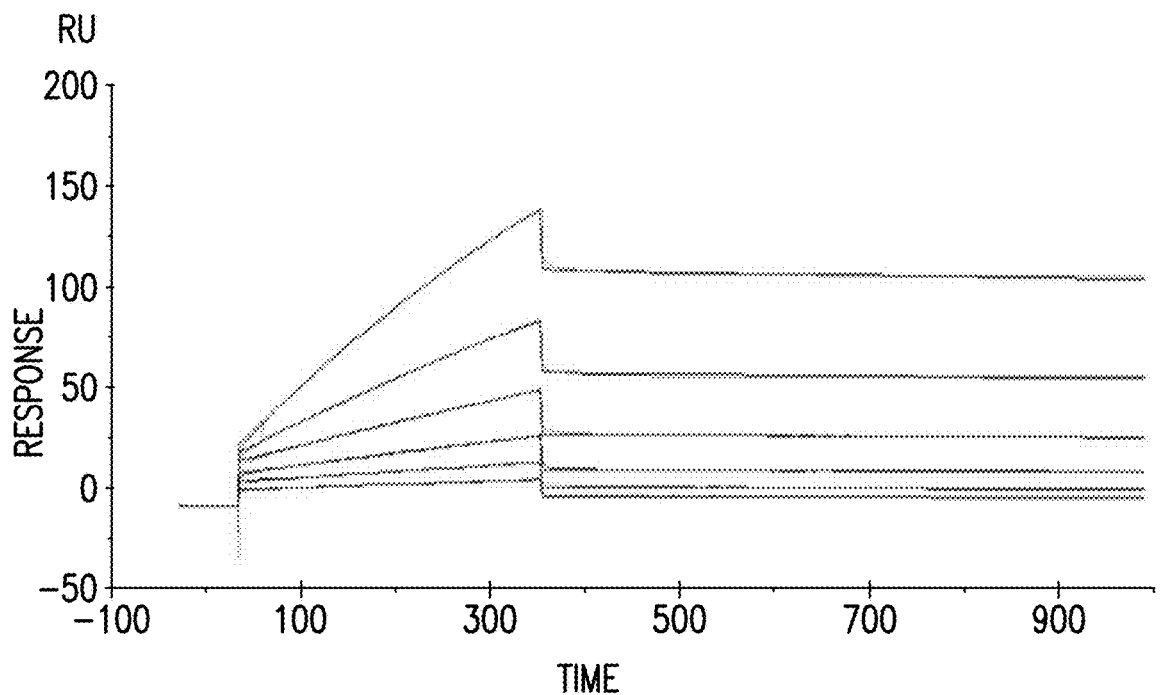
FIGS. 41A-41D show binding of activated Pb-IFN-a2b to interferon alpha receptors in vitro. Human IFNAR1, human IFNAR2, cyno IFNAR1 or cyno IFNAR2 proteins were captured on a chip coated with immobilized anti-human Fc. Concentrations of activated IFN-a2b (ProC1640) ranging from 25 nM to 1.5625 µM were flowed over the ligand-captured chip to generate multi-cycle kinetic sensorgrams.
Figure 41B:
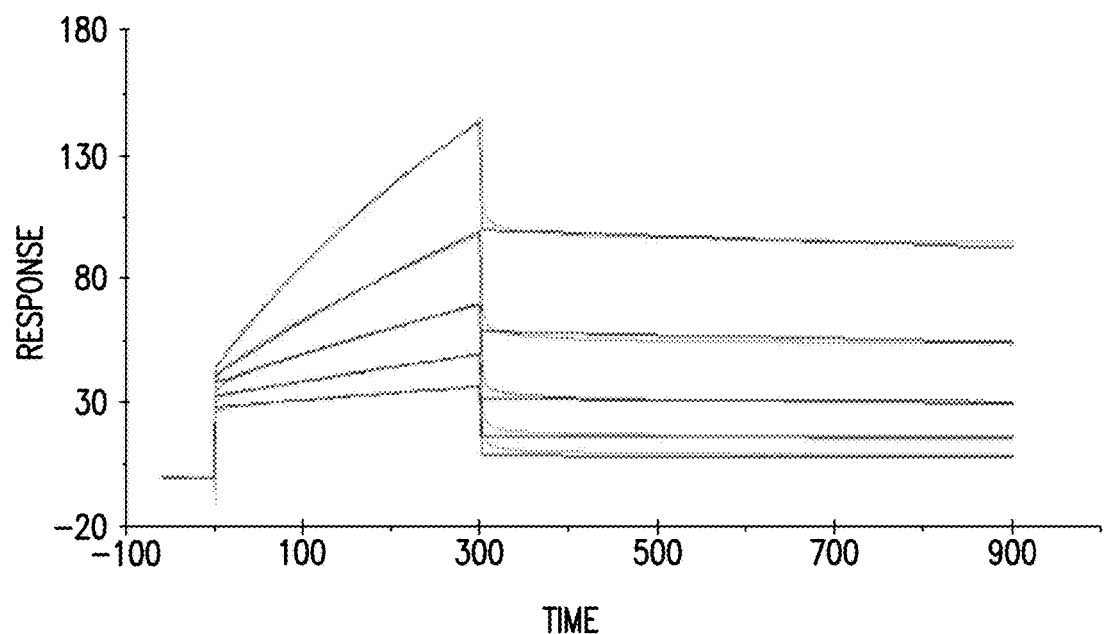
Figure 41C:
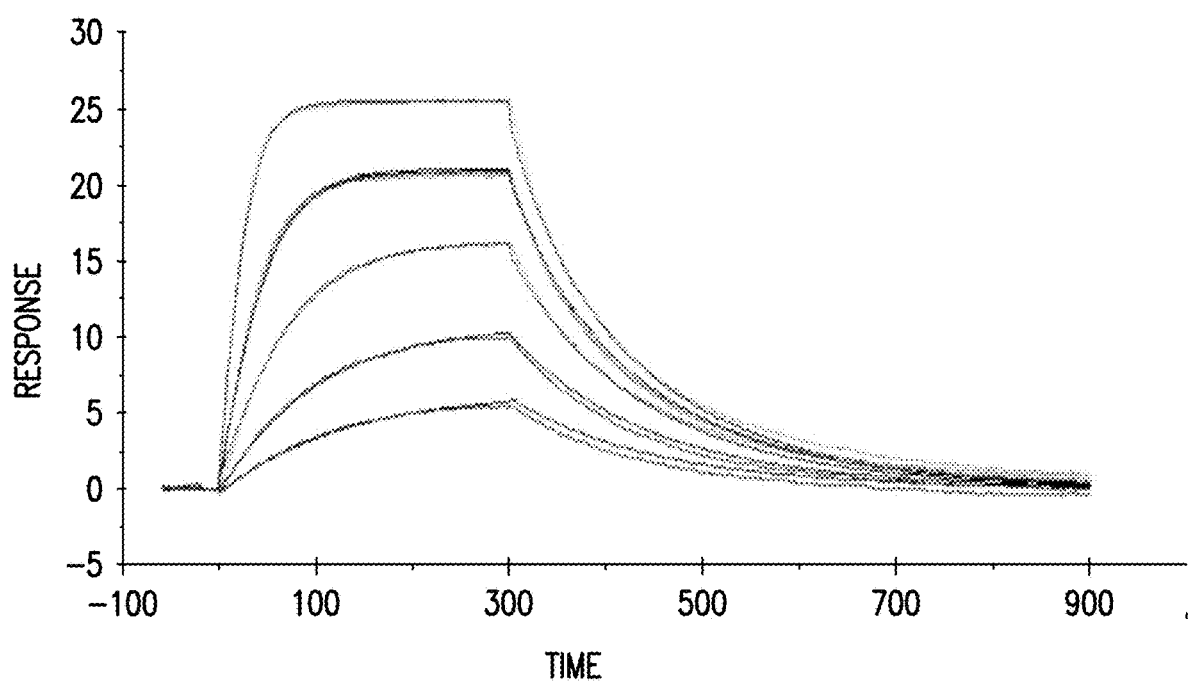
Figure 41D:
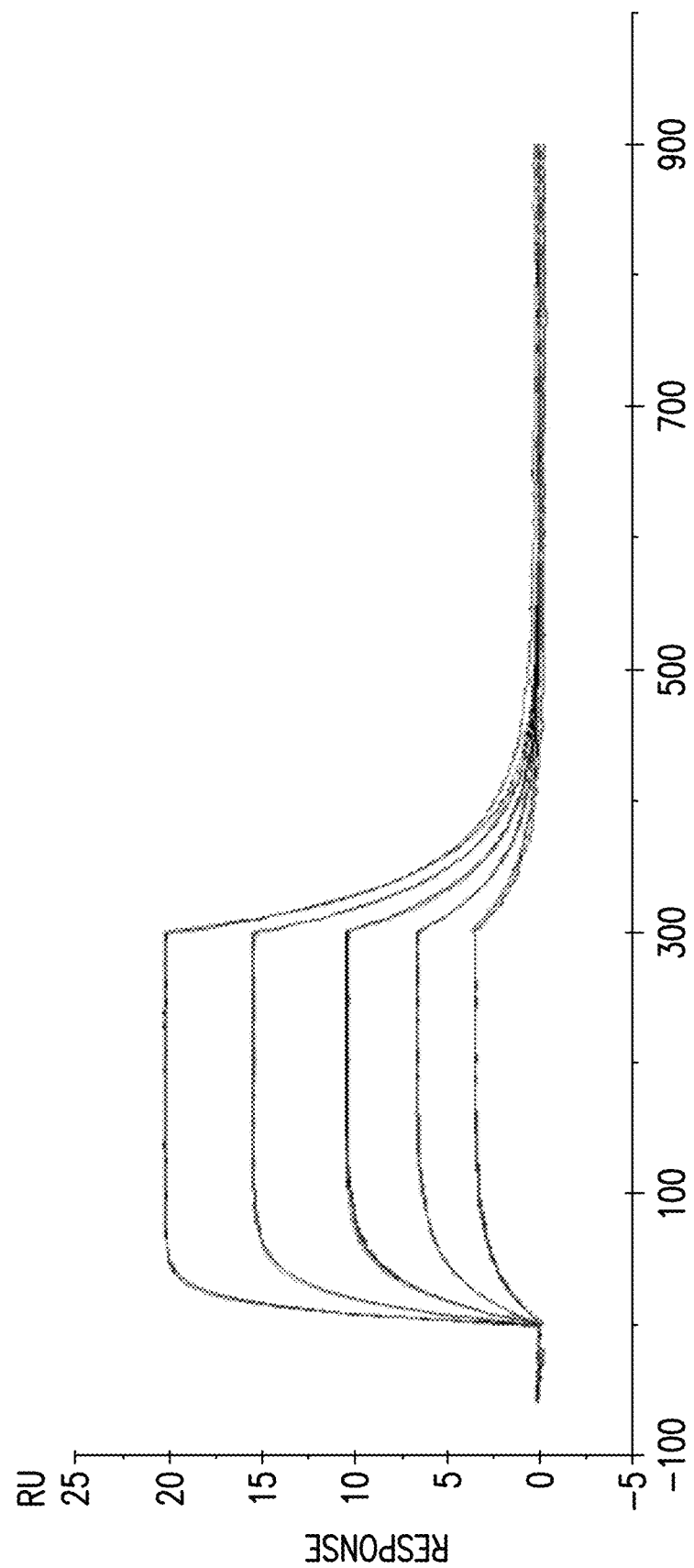

Example 18: Binding of Activated Pb-IFN-a2b to Interferon Alpha Receptors In Vitro Pb-INF-a2b was activated in vitro with uPA, and the active fraction was purified by chromatography (ProC1640). Interferon alpha receptor 1 human (ProC1822) and cyno (ProC1824), as well as IFNAR2 human (ProC1823) and cyno (ProC1825) were expressed as recombinant proteins and purified. Binding was performed in vitro using the surface plasmon resonance approach. The ligands were captured on a chip coated with immobilized anti-human Fc or anti-histidine antibodies. Regeneration conditions to permit multi-cycle kinetic measurements were established. Different concentrations of analytes were flowed over the ligand-captured chip to generate multi-cycle kinetic sensorgrams that were analyzed to obtain the kinetic rate constants and the affinity constant using a 1:1 binding model.

ProC1640 binds to human and cyno IFNAR1, however affinity and specificity of the interaction could not be determined with current method due to extremely slow dissociation of the molecules. Binding of the activated fraction of the IFN-a2b to human IFNAR2 and cyno IFNAR2 was detected. As shown in FIGS. 41A-41D, ProC732 binds to human and cynomolgus monkey interferon alpha receptor IFNAR2 with similar affinity. FIG. 41A shows human IFNAR1 response over time. FIG. 41B shows cynomolgus monkey IFNAR1 response over time. FIG. 41C shows human IFNAR2 response over time. FIG. 41D shows cynomolgus monkey IFNAR2 response over time.

Affinity to hIFNAR2 was 2.7 nM, cyno—9.3 nM as shown in the following table: Summary of binding studies with IFN-a2b molecules

| Ligand | Analyte | ka (1/Ms) | kd (1/s) | KD (nM) |
|---|---|---|---|---|
| ProC1823 | ProC1640 | 4.374E+06 | 1.195E-02 | 2.731 |
| ProC1825 | ProC1640 | 2.674E+06 | 2.501E-02 | 9.353 |
| ProC1823 | ProC1976 | 8.985E+04 | 1.175E-02 | 130.8 |
| ProC1718 | ProC1640 | 5.177E+06 | 1.214E-02 | 2.344 |
| ProC440 | ProC1718 | 2O55E+05 | 2.077E-02 | 101.1 |

For confirmatory studies, binding of the activated Pb-IFN-a2b (ProC1640) to Fc-tagged dimeric IFNAR2 (ProC1718) was analyzed. The Kd of the interaction of ProC1640 with ProC1718 was 2.3 nM.

Therefore, human IFN-a2b binds to human and cynomolgus monkey IFNAR2 with similar affinity. Format and valency of the ligand did not affect measurement results.

Example 19: Binding of Single Masked Pb-IFN-a2b Molecules to IFNAR2

Binding of masked Pb-INF-a2b to human IFNAR2 was performed as described above. Direct comparison of the peptide masked IFN-a2b (ProC1976) with its unmasked version (ProC1640) demonstrated ~50× affinity differential (130.8 nM vs 2.7 nM, respectively). Furthermore, sterically masked molecule (ProC440) binds to IFNAR2 with significantly reduced affinity (kD=101.1 nM) compared to the unmasked molecule. As shown in FIGS. 42A-42D, each of the peptide masks (FIG. 42A (no peptide mask) vs. FIG. 42B (peptide masked)) and the Fc masks (FIG. 42C (no Fc mask) vs. 42D (Fc masked)) affect binding of the ACC to the receptor. In view of the data, synergistic activity has been obtained through the use of the dual masking structure of the ACCs of the present disclosure. Therefore, both affinity and steric masking decreases binding of the IFN-a2b to IFNAR2.

Example 20: Activation of ACCs by Tumor Tissues

Figure 37A:
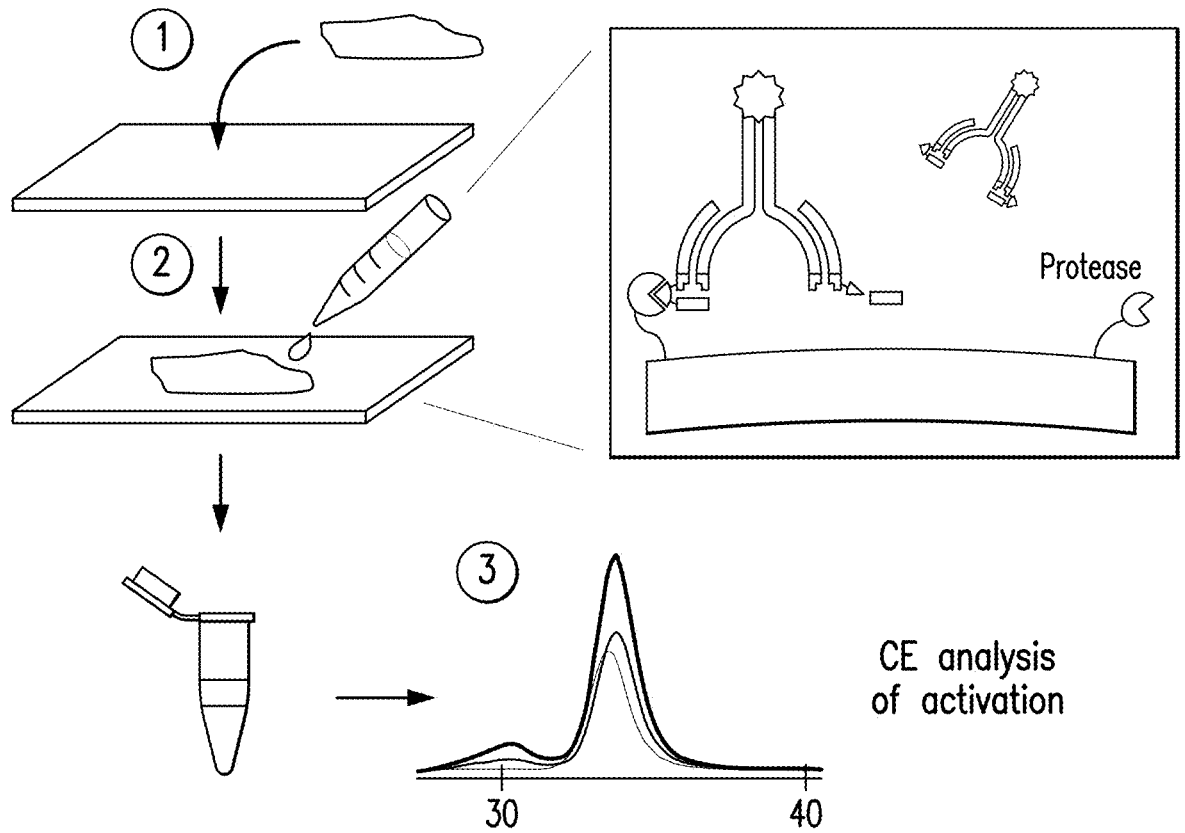
FIGS. 37A-37C show an assay of activation of ProC732 by tumor tissues (FIG. 37A) and results. Fluorescently labeled ProC732 was incubated on tumor tissue sections at 37° C. Recovered solution was then analyzed through capillary electrophoresis enabling quantification of active molecules (FIG. 37C) and using HEK-blue IFNA reporter model (FIG. 37B). Enzymatically inactive samples were used as control tissues.

Fluorescently labeled ProC732 was incubated with enzymatically active tumor samples or low-activity control tissues at 37° C. as shown in FIG. 37A as described in (Howng, B, Winter, MB, LePage, C, et al. Novel Ex Vivo Zymography Approach for Assessment of Protease Activity in Tissues with Activatable Antibodies. Pharmaceutics 2021; 13:1390). Proteins recovered after 2 or 16 hours of incubation were analyzed for activation status (capillary electrophoresis) and bioactivity (HEK-blue reporter assay). Recovered solution was then analyzed through capillary electrophoresis enabling quantification of active molecules or low-activity control tissue (FIG. 37B) or using HEK-blue IFNA reporter model (FIG. 37C). Enzymatically inactive samples were used as control tissues. The results demonstrate the activation of ProC732 in the tumor microenvironment.

Figure 37B:
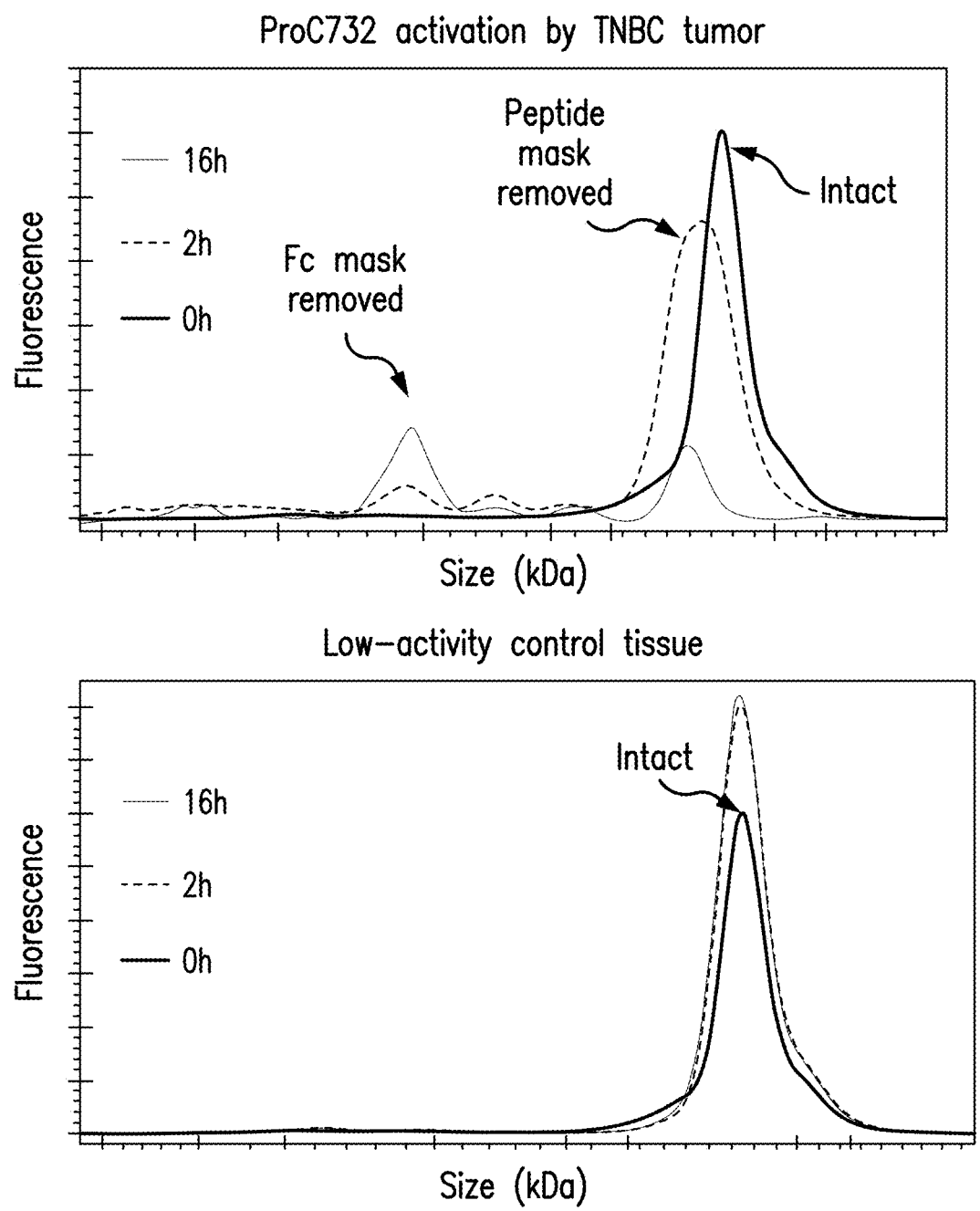
Figure 37C:
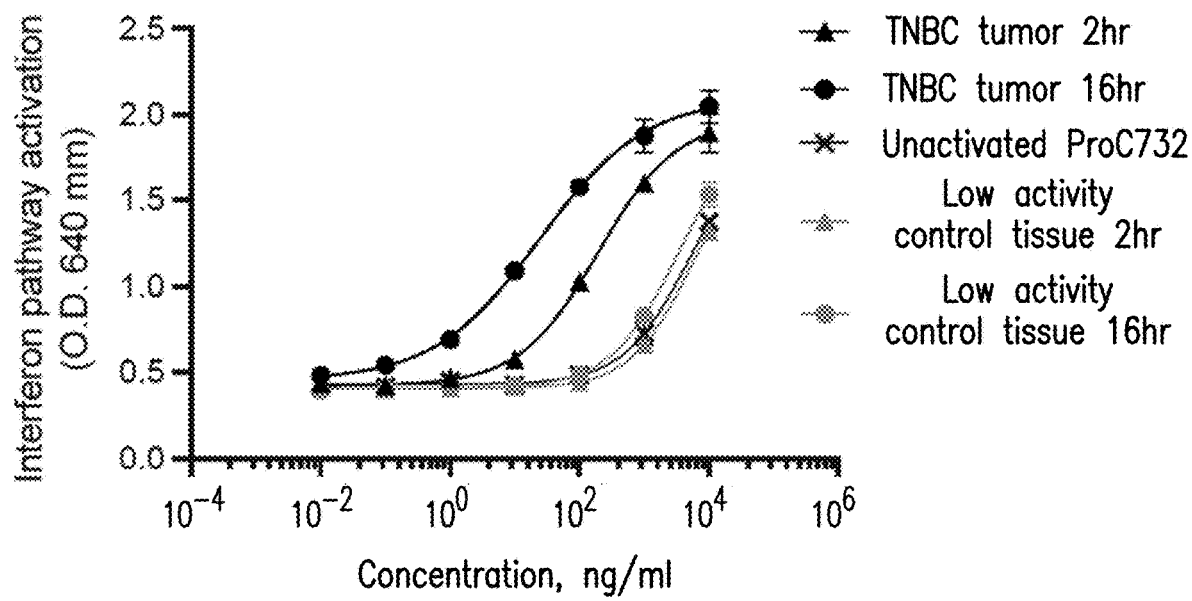

Incubation with breast carcinoma tumor samples but not low-activity control tissues resulted in appearance of protein products corresponding to molecules expected to be generated after release of steric (Fc fragment) and affinity (CS49 peptide) masks (FIG. 37B). Release of the peptide mask was detected earlier while separation of the Fc mask was more pronounced at the later time point. Pb-IFN-a2b samples incubated with the breast carcinoma tissues, but not control tissues demonstrated increased potency in the IFN pathway activation assay (FIG. 37C). 16 h incubation resulted in higher potency as compared to 2 h.

The observation is consistent with time-dependent release of the steric and peptide masks from the Pb-IFN-a2b molecule, and therefore, proteolytic activation of Pb-IFN-a2b by tumor tissues.

Example 21: Changes in Bioactivity of the Interferon Molecules after Incubation with Tumor Tissues Fully masked Pb-INF-a2b (ProC732) or in vitro activated (ProC1640) IFN-a2b proteins were incubated with tumor samples. Proteins recovered after 2, 6 or 24 hours of incubation were analyzed for bioactivity using HEK-blue reporter assay.

Figure 38A:
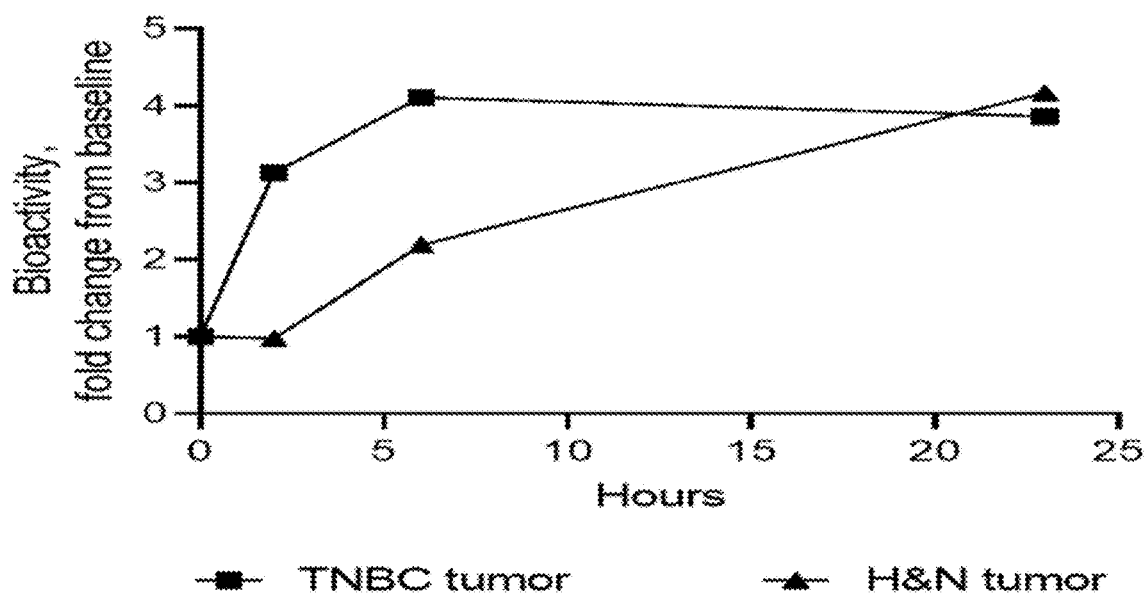
FIGS. 38A-38C show changes in bioactivity of ProC732 (FIG. 38A) and recombinant IFN-a2b (FIG. 38B) molecules after incubation with tumor tissues analyzed by HEK-blue IFNA reporter model. Fold change of bioactivity of 10 ng/mL ProC732 or 1 ng/mL of recombinant IFN-a2b was calculated relative to 0 h values. Bioactivity of ProC732 and IFN-a2b proteins incubated in the absence of tumor tissues for 24 h (FIG. 38C). Each line connects an individual sample (concentration range 100-0.01 ng/mL) analyzed before and after 24 h incubation.
Figure 38B:
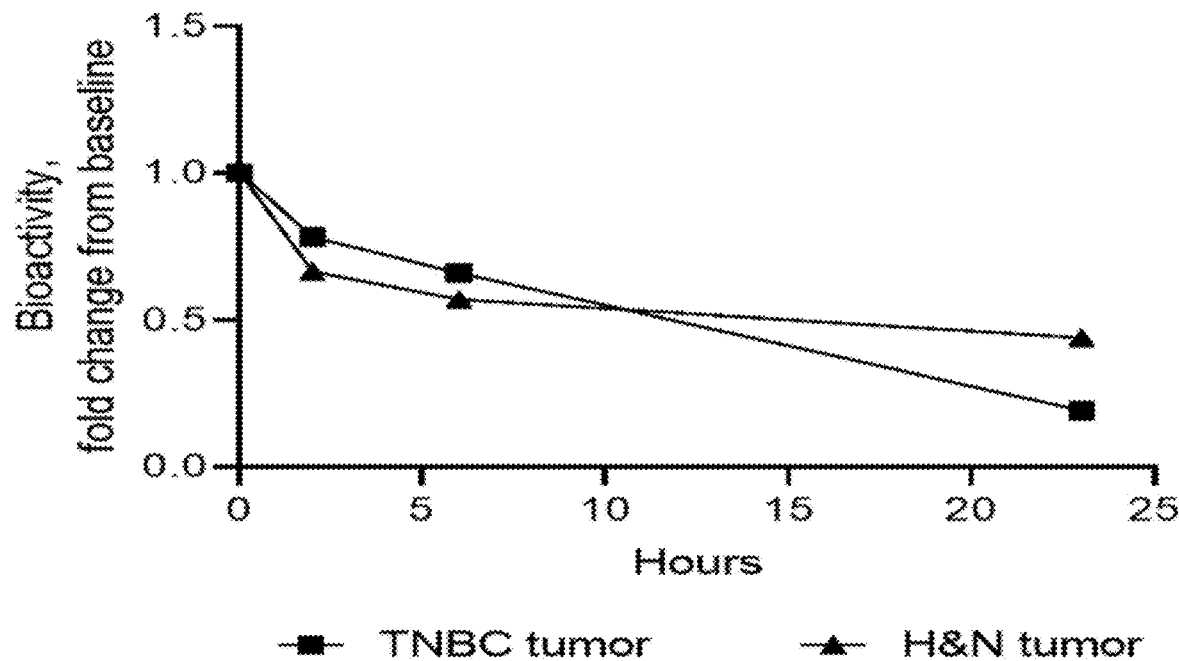
Figure 38C:
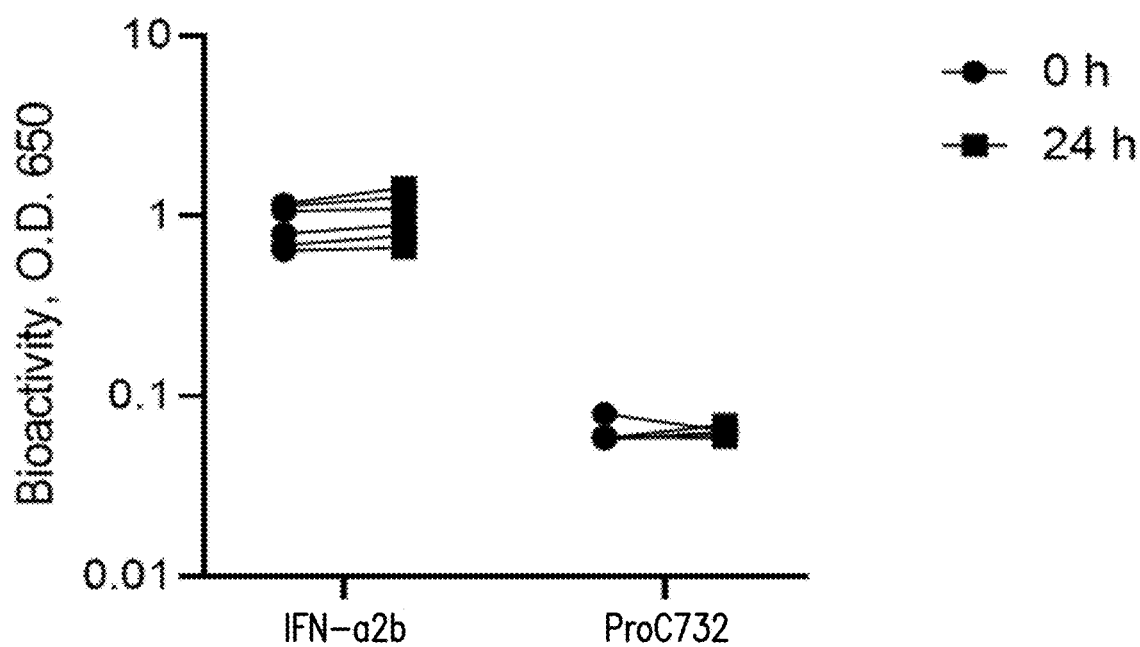

Incubation with enzymatically active tumor tissues resulted in activation and enhanced bioactivity of Pb-IFN-a2b. On contrary, incubation with tumor tissues reduced bioactivity of the unmasked interferon, potentially by proteolytic degradation of the molecule. Bioactivity of control samples of both Pb-IFN-a2b and unmasked IFN-a2b did not change upon incubation in the absence of tumor. As shown in FIGS. 38A-38C, ProC732 or recombinant IFN-a2b were incubated on TNBC and head and neck ("H&N") tumor tissue sections or in tumor-free glass area at 37° C. Recovered solutions were then analyzed by HEK-blue IFNA reporter model. FIGS. 38A and 38B show the fold change of bioactivity of 10 ng/mL ProC732 or 1 ng/mL of recombinant IFN-a2b calculated relative to 0 hour values. FIG. 38C shows bioactivity of ProC732 and IFN-a2b proteins incubated in the absence of tumor tissues for 24 h. Each line connects an individual sample (concentration range 100-0.01 ng/mL) analyzed before and after 24 h incubation.

The results suggest that exposure to tumor tissue could degrade unmasked interferon molecules in vitro. Masked Pb-IFN-a2b retains and enhances its bioactivity after tumor exposure.

Example 22: Pharmacokinetics of the Masked INF-a2b and Control Molecules in Non-Human Primates To understand PK/PD properties of the Pb-IFN-a2b in cynomolgus monkey, animals (N=2 per group) were treated with a single dose subcutaneous administration of Pb-IFN-a2b at 0.03, 0.3, 3 or 15 mg/kg. Plasma samples were collected at indicated time points and analyzed for total Pb-IFN-a2b concentration. Concentrations of IP-10 in the serum were measured by the MesoScale Discovery MSD V-plex assay.

Figure 39:
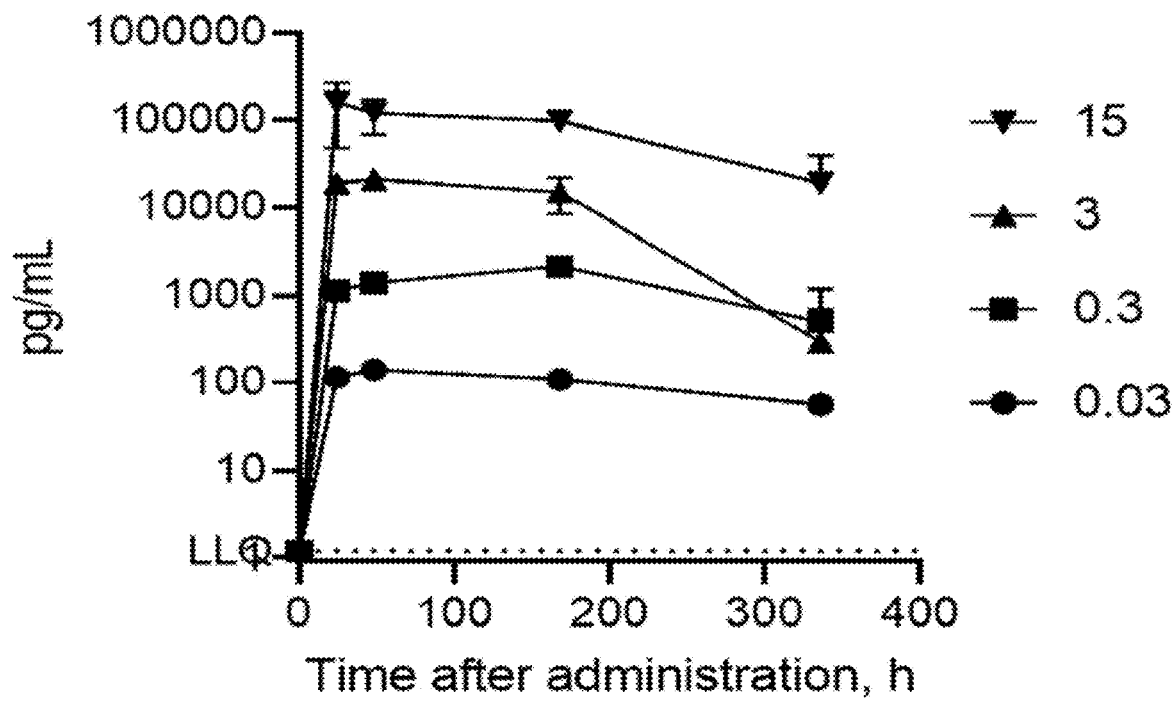
FIGS. 39, 40A, and 40B show pharmacokinetics of the masked INF-a2b and control molecules in non-human primates. Cynomolgus monkey (N=2 per group) were treated with a single dose subcutaneous administration of ProC732 at 0.03, 0.3, 3 or 15 mg/kg.

Administration of ProC732 resulted in dose-dependent increase in plasma concentrations of the drug starting from the first measurement at 24 h after administration (FIG. 39). Plasma concentrations of the Pb-IFN-a2b were maintained for at least 2 weeks after the administration.

Figure 40A:
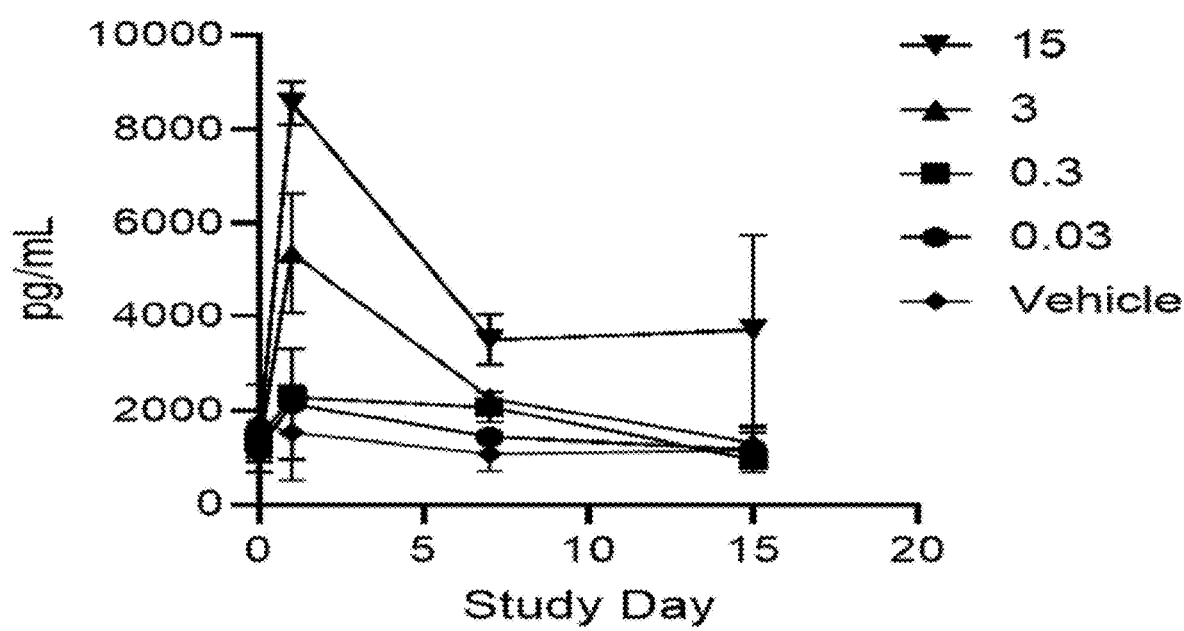
Figure 40B:
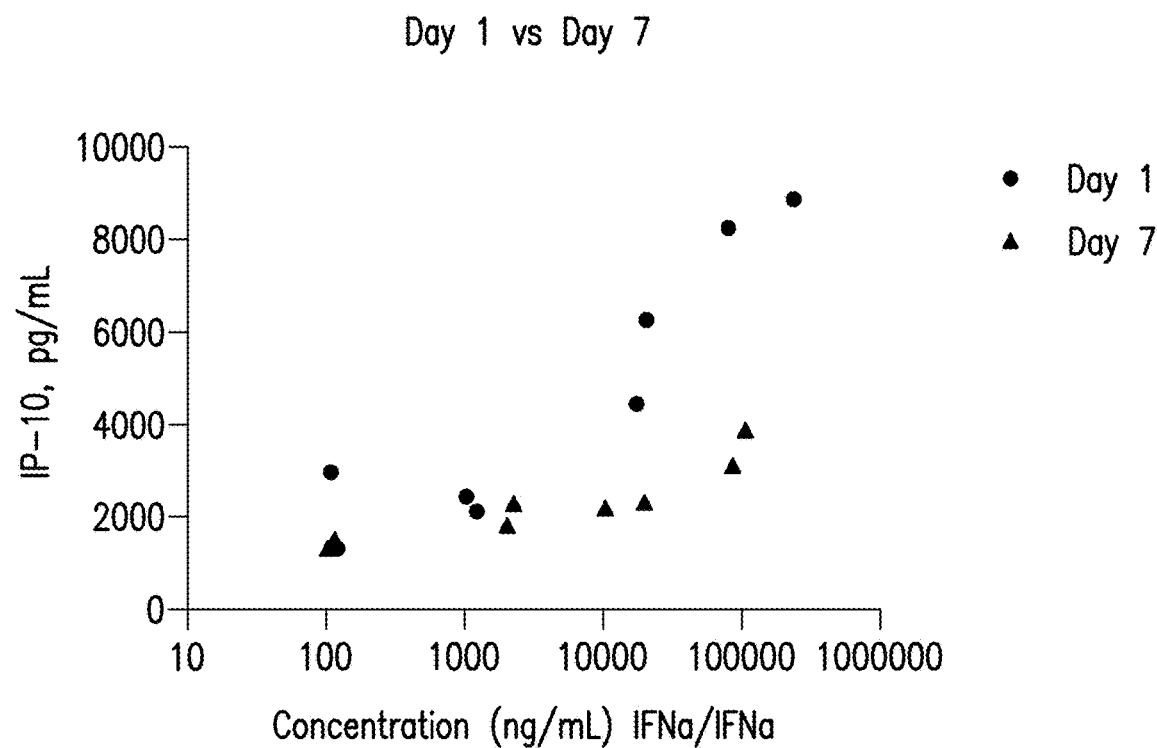

Elevated serum concentrations of IP-10 were detected in treated animals as early as 24 h after the administration (FIG. 40A). Magnitude of the increase was correlated with dose level; 15 and 3 mg/kg administrations resulted in IP-10 concentrations above 8 and 4 ng/mL respectively. Seven days after the administration, serum levels of IP-10 came back to the physiological concentration in all animals except the monkeys treated with the highest dose level. Concentrations of circulating Pb-IFN-a2b and IP-10 plotted against each other at day 1 and day 7 after administration (FIG. 40B).

The results are consistent with extended half-life of Pb-IFN-a2b in hon-human primates. Transient increase in IP-10 after treatment with high dose of Pb-IFN-a2b indicates that the molecule can activate the type I IFN signaling pathway in non-human primates then given at high dose levels.

Example 23: Gene Expression Profile Changes Induced by Pb-INF-a2b Non-Human Primates Cynomolgus monkeys were treated with Pb-IFN-a2b as described previously. PBMC were isolated from whole blood at 24 h after the administration. Gene expression profile changes induced by ProC732 in cynomolgus monkeys were analyzed. Cynomolgus monkey (N=2 per group) were treated with a single dose subcutaneous administration of ProC732 at 0.03, 0.3, 3 or 15 mg/kg. Bulk mRNA from isolated cells was subjected to paired-end 150c RNAseq high-throughput sequencing. Unique gene hit counts were calculated by using Subread package v.1.5.2. Using DESeq2, a comparison of gene expression between the indicated groups of samples was performed. The Wald test was used to generate p-values and log 2 fold changes. Genes with an adjusted p-value <0.05 and absolute fold change>3 were called as differentially expressed genes for each comparison.

Figure 43:
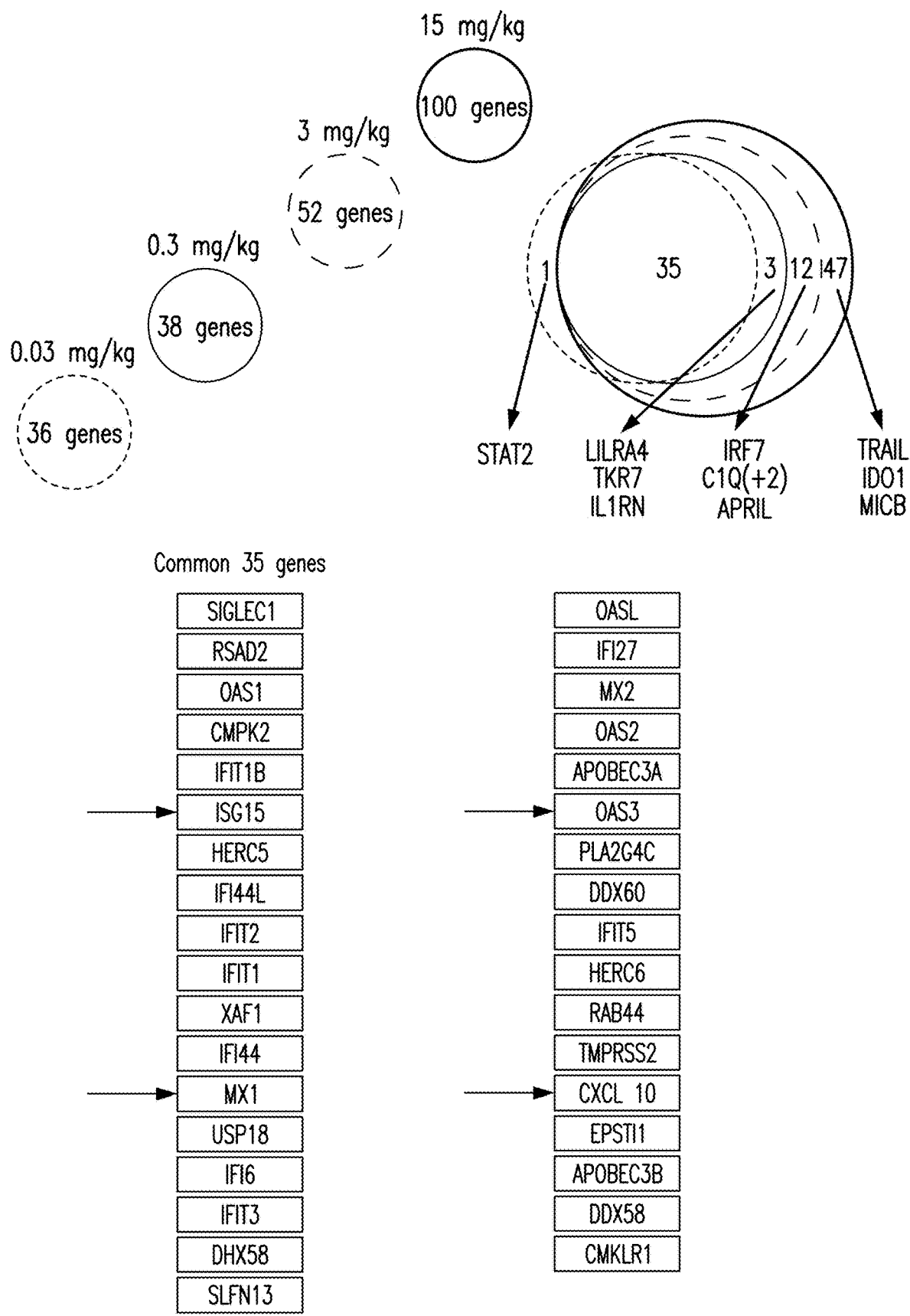
FIGS. 43 and 44 show gene expression profile changes induced by ProC732 non-human primates based on concentration (FIG. 43). Cynomolgus monkey (N=2 per group) were treated with a single dose subcutaneous administration of ProC732 at 0.03, 0.3, 3 or 15 mg/kg. PBMC from treated animals were harvested and analyzed by bulk RNAseq. Genes were called differentially expressed if number of reads changes were >3 (FIG. 44).
Figure 44:
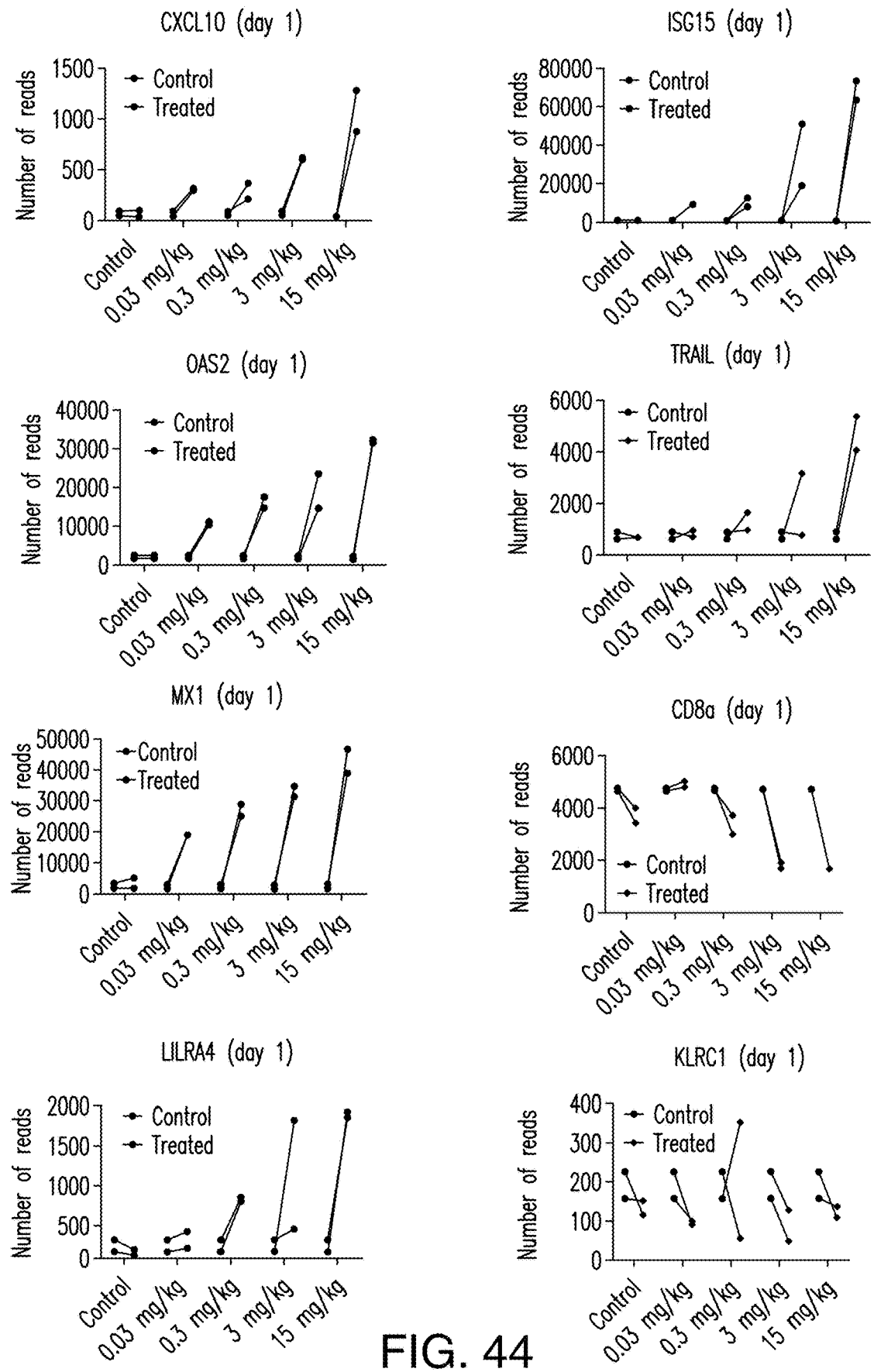
Figure 44:
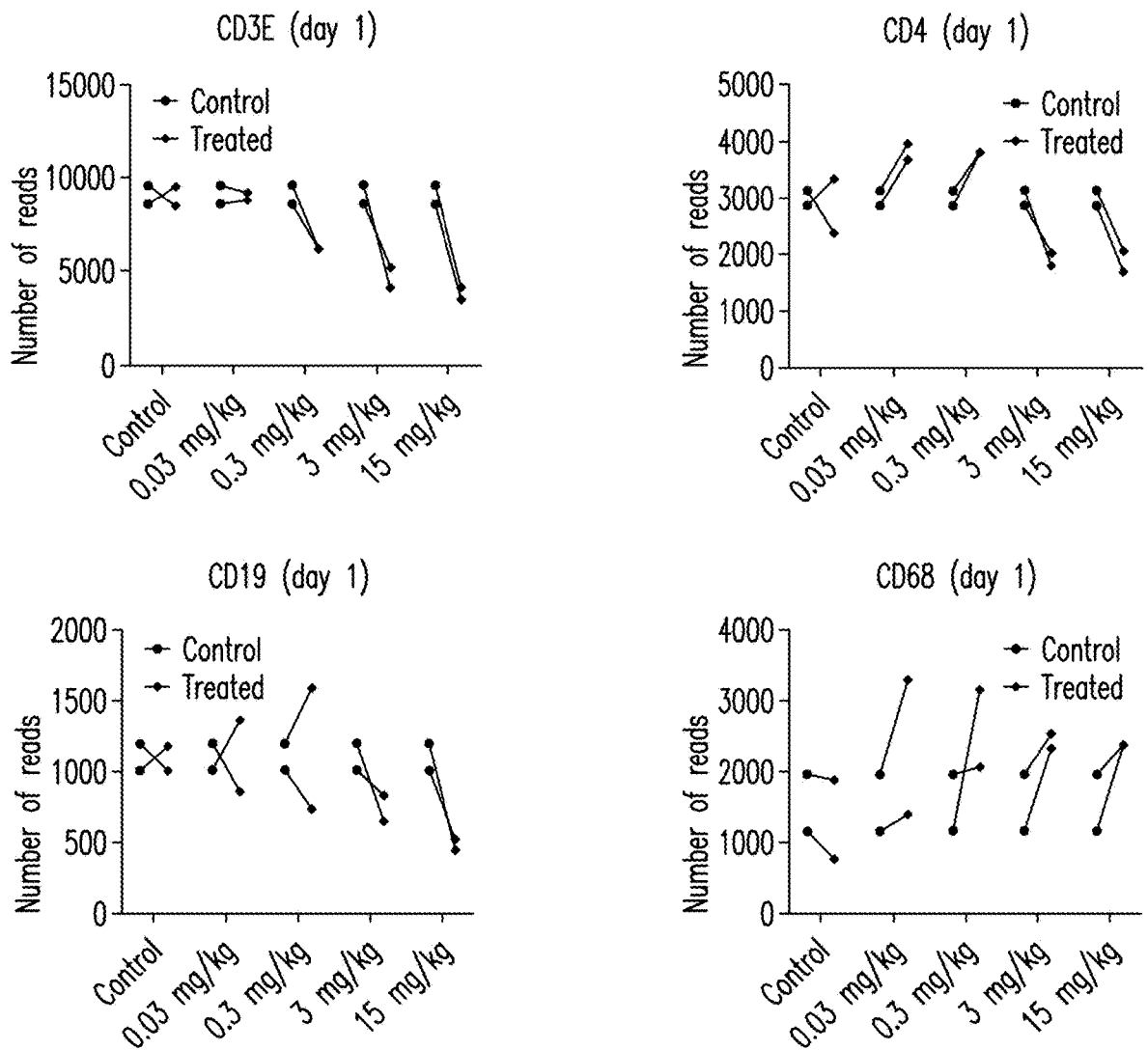

Administration of Pb-IFN-a2b at all dose levels was associated with upregulation of 35 genes in circulating leucocytes (FIG. 43). Additional numbers of genes (3, 12, and 47) were upregulated by increased dose level of administered Pb-IFN-a2b (0.3, 3, and 15 mg/kg), respectively. Many of the upregulated genes belong to the group identified as ISG, or interferon-stimulated genes, known to be induced by type I interferons. Analysis of individual upregulated genes indicated dose-dependent pattern of induction where most evident changes were associated with the top dose level of the Pb-IFN-a2b. FIG. 44 shows the dose-dependent changes in gene expression. Genes were called differentially expressed if number of reads changes were >3.

The results are consistent with in vivo activation of type I IFN signaling by Pb-IFN-a2b.

Example 24: In Vivo Characterization of Pb-INFa-A/D

The antitumor activity of the masked IFNa-A/D (ProC1023) was tested in vivo using MC38 tumor model. Mice (N=10 per group) were be implanted subcutaneously with 1.5×10⁶ MC38 cells in serum-free medium. Body weights and tumor measurements were recorded twice weekly for the duration of the study. When the average tumor volume has reached 80 mm³, mice were dosed with the indicated amounts of ProC1023 by a single subcutaneous injection. Previously we established that masked IFNa-A/D demonstrate antitumor activity in the 50-200 ug dose level. Administration of 50 ug resulted in significant tumor growth inhibition, while administration of 200 ug also resulted in rejection of the tumors by 60% of the animals. In this experiment, animals were euthanized 6 days after the administration and tumors, tumor-draining lymph nodes, and spleens were collected and processed into single-cell suspensions. Composition and activation of tumor immune infiltrate was analyzed by flow cytometry performed with total cells and gated on viable CD45+CD3+ subsets.

Figure 45:
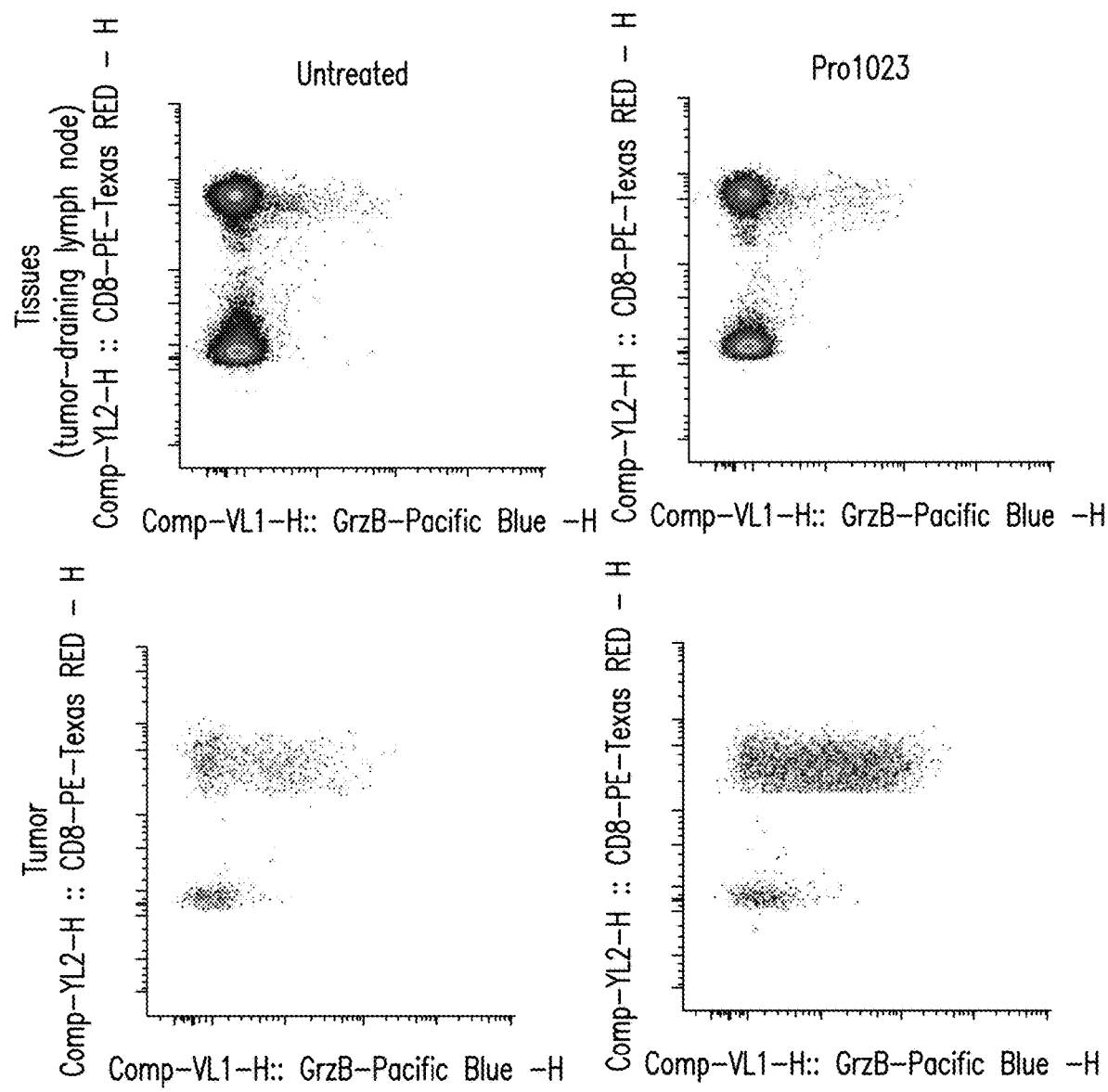
FIG. 45 shows that ProC1023 preferentially activates immune cells in tumor tissues. Six days after the treatment tumors and tissues were harvested and analyzed by flow cytometry. Gated on viable CD45+CD3+ cells.
Figure 45:
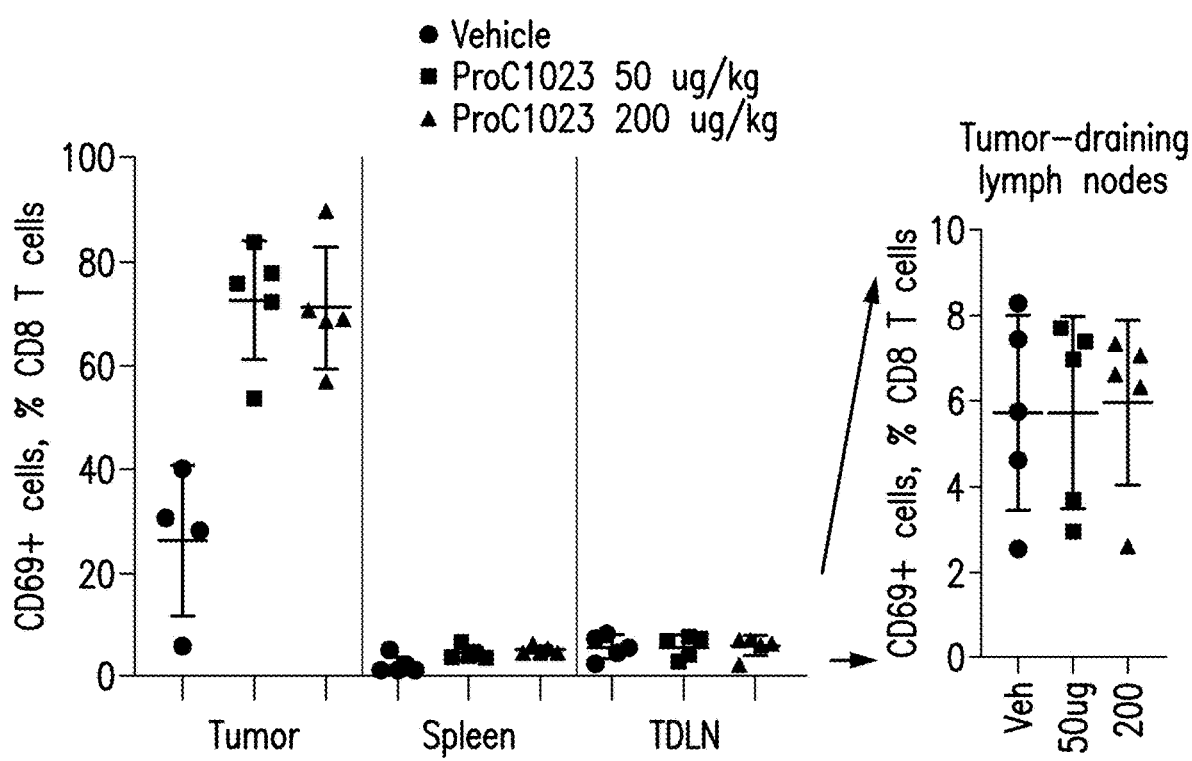

In mice treated with Pb-IFNa-A/D, CD8+ T cell subset in tumor microenvironment (TME), but not in peripheral tissues demonstrated enhanced activation, including production of effector molecules associated with tumoricidal activity (FIG. 45). Granzyme B is an effector molecule of cytotoxic T cells that could be induced by type I interferon signaling. Administration of Pb-IFNa-A/D was associated with significant increase in frequency of Granzyme B positive and CD69 positive CD8+ T cells in tumors, while where was no major changes in peripheral tissues, including tumor-draining lymph nodes.

Thus, the data show that Pb-IFNa-A/D mediates immune activation in tumor but not in periphery. The pattern of immune activation was generally consistent with published effects of type I interferon. The tumor-preferred manner of immune activation shows activation of the ACCs by tumors through proteolytic cleavage. The observation is in agreement with immune-mediated mechanism of MC38 tumor growth suppression by Pb-IFNa-A/D.

Example 25: In Vivo Tolerability of the Pb-IFN-a2b

Human IFNα-2b cross-reacts with hamster IFNα receptor and has been previously shown to be active in hamsters (Altrock et al, Journal of Interferon Research, 1986). Improved tolerability of the ProC732 compared to unmasked IFN-a2b-Fc fusion (ProC286) or single (sterically) masked IFN-a2b (ProC440) in hamsters after single administration was shown in Example 2. In this Example 25, tolerability of the Pb-IFNα-2b in Syrian Gold Hamsters was determined after multiple administrations.

Figure 46:
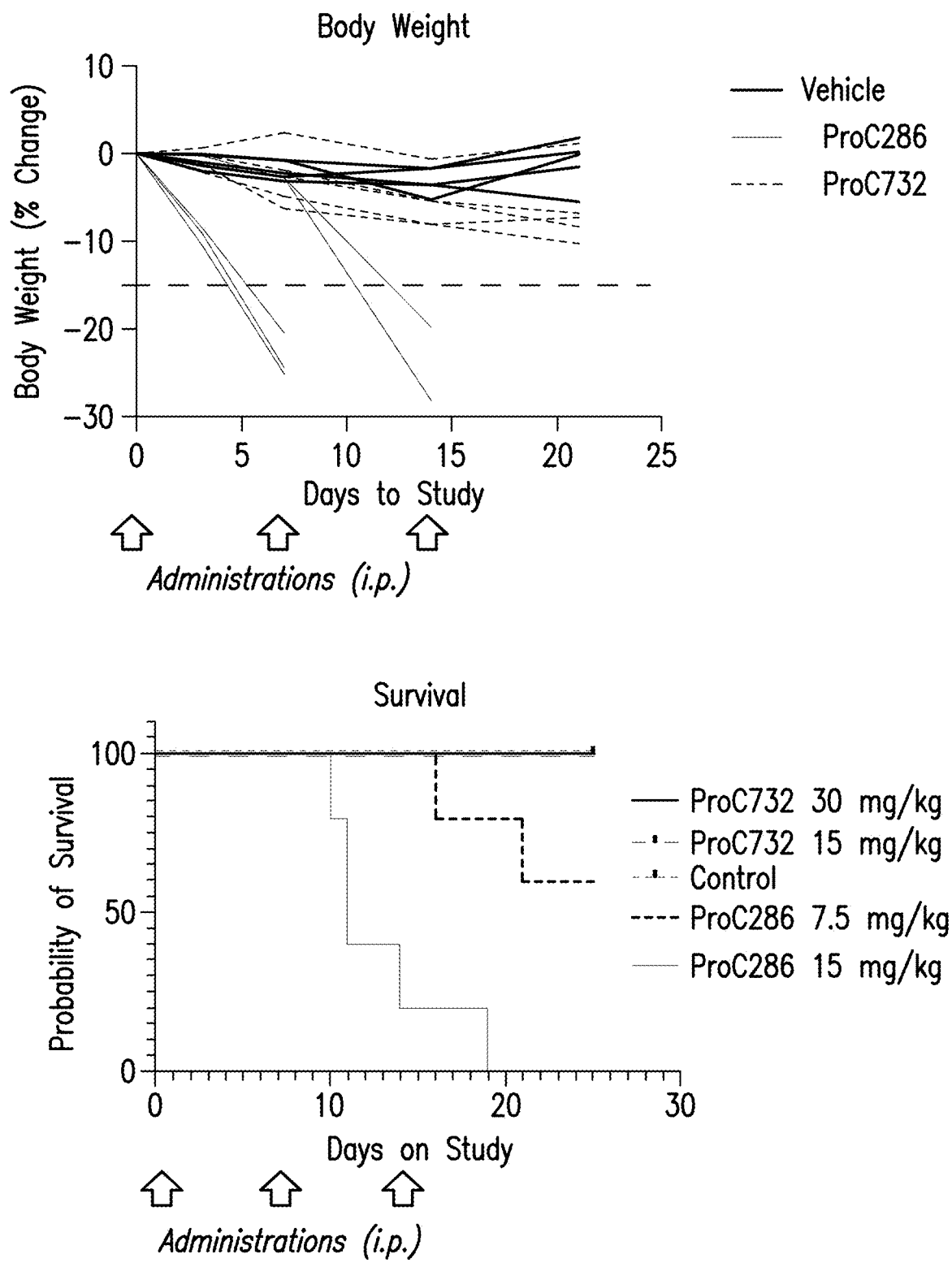
FIG. 46 shows that ProC732 is well tolerated after multidose administration. Male Syrian golden hamsters (N=5) were treated i.p. with three weekly administrations of ProC732 or unmasked Fc-IFN-a2b (ProC286) fusion proteins and monitored for body weight changes and survival prior to dosing and twice a week post-dose.

Animals (N=5 per group) were dosed with ProC732 15 or 30 mg/kg dose level or unmasked IFN-a2b-Fc fusion protein (ProC286) at 7.5 or 15 mg/kg dose level, i.p. once weekly for total 3 administrations. Clinical observations, body weights & temperature were measured prior to dosing, and twice weekly thereafter. Animals dosed with the unmasked IFN molecules (ProC286) showed significant body weight loss as early as 3 days after first administration (FIG. 46). The first animal dosed with 15 mg/kg ProC286 was euthanized at day 10 due to excessive weight loss (>25%) and all the other animals were either euthanized due to excessive weight loss, inactivity and lethargy or were found dead between days 11 and 19. Similar observations were made for the animals treated with lower (7.5 mg/kg) dose of the unmasked INF-a2b. In contrast, none of the animals treated with ProC732 up to 30 mg/kg demonstrated significant loss of weight or morbidity.

The results are in agreement with increased safety of Pb-IFN-a2b due to the use of the dual masking structure used in the present disclosure.

Example 26: Reduced Cytokine and Chemokine Release in Cynomolgus Monkey Treated with Single Dose Administration of the Pb-IFN-a2b To understand effect of masking of the Pb-IFN-a2b in cynomolgus monkeys, animals (N=2 per group) were treated with a single dose subcutaneous administration of Pb-IFN-a2b (ProC732) at 1 mg/kg of unmasked control molecule ProC286 at 1 or 0.1 mg/kg. Plasma samples were collected at indicated time points and analyzed for IP-10, MIP-1b and IL-12p'70 concentrations using the multiplex MSD V-plex assay.

Figure 47:
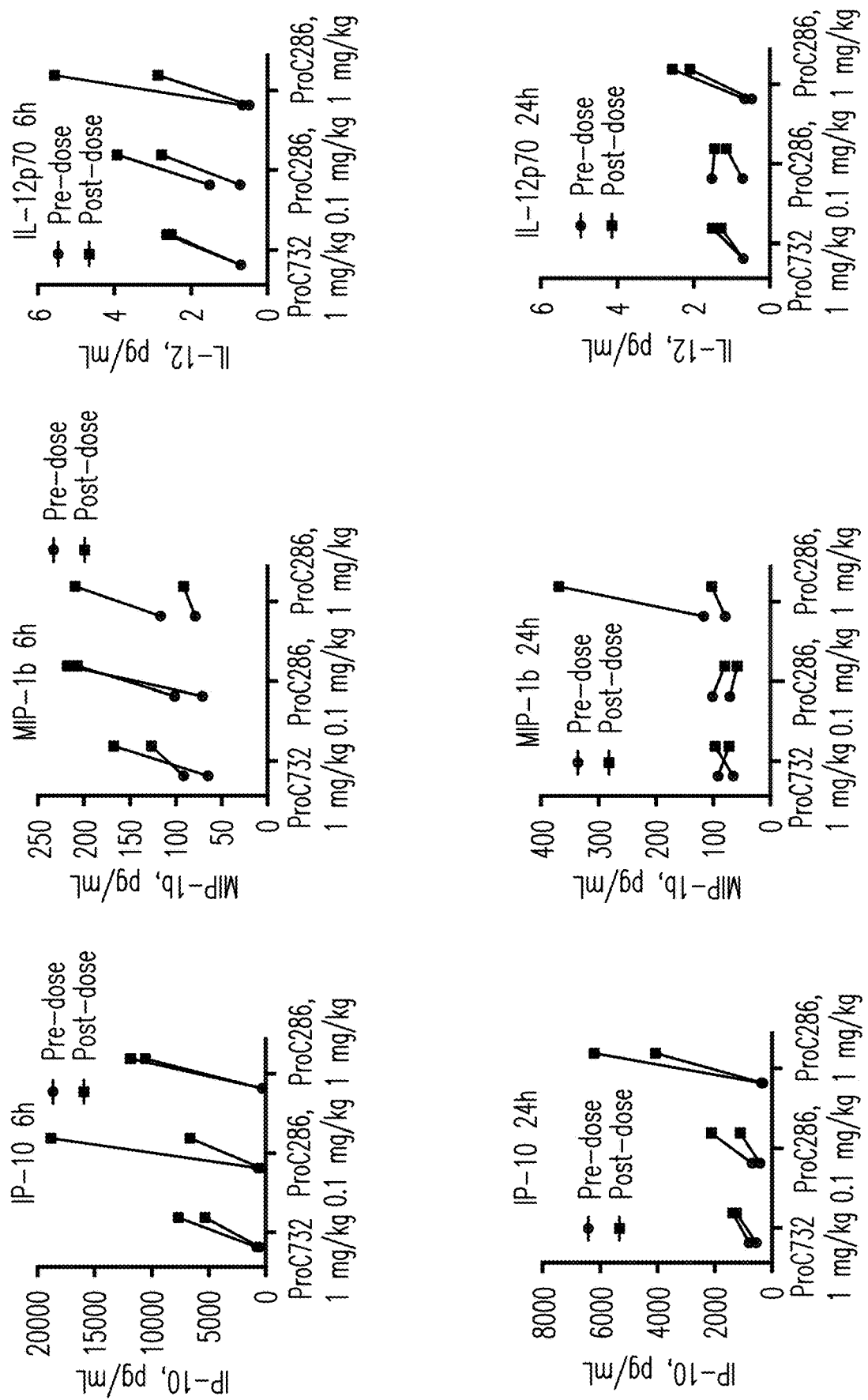
FIG. 47 shows that masking of ProC732 attenuates cytokine/chemokine release in non-human primates.

As shown in FIG. 47, administration of ProC732 resulted in elevation of the plasma IP-10 and MIP-1b level 6 hours after the administration. Plasma concentrations of all measured molecules were higher in animals treated with unmasked molecule at high and low dose level. 24 hours after the administration only slight elevation of IP-10 was noted in animals treated with ProC732. On contrary, animals received 1 mg/kg of ProC286 demonstrated highly elevated IP-10 levels. IP-10 elevation observed 24 hours after administration of 0.1 mg/kg ProC286 was greater than such induced by 10-fold higher dose of ProC732.

The results indicate attenuated induction of biomarkers of type I interferon response in non-human primates treated with ProC732 as compared to unmasked cytokine-Fc fusion. The observation is in agreement with masking effects.

TABLE 11

Example sequences

| SEQ ID NO. | NAME | SEQUENCE |
|---|---|---|
| 1 | Human Interferon-alpha-2b | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRADIVIRSFSLSTNL QESLRSKE |
| 2 | Linker | GGGS |
| 3 | Human IgG4, S228P truncated Fc Region | CPPCPAPEFLGGPSVFLFPPKPKDTLMISRTPEVTCVVVD VSQEDPEVQFNWYVDGVEVHNAKTKPREEQFNSTYRV VSVLTVLHQDWLNGKEYKCKVSNKGLPSSIEKTISKAKG QPREPQVYTLPPSQEEMTKNQVSLTCLVKGFYPSDIAVE WESNGQPENNYKTTPPVLDSDGSFFLYSRLTVDKSRWQ QGNVFSCSVMHEALHNHYTQKSLSLS |
| 4 | Human IgG4 Fc region, with S228P mutation and full hinge | ESKYGPPCPPCPAPEFLGGPSVFLFPPKPKDTLMISRTPEV TCVVVDVSQEDPEVQFNWYVDGVEVHNAKTKPREEQF NSTYRVVSVLTVLHQDWLNGKEYKCKVSNKGLPSSIEK TISKAKGQPREPQVYTLPPSQEEMTKNQVSLTCLVKGFY PSDIAVEWESNGQPENNYKTTPPVLDSDGSFFLYSRLTV DKSRWQQGNVFSCSVMHEALHNHYTQKSLSLS |
| 5 | CM | LSGRSDNH |
| 6 | CM | TGRGPSWV |
| 7 | CM | PLTGRSGG |
| 8 | CM | TARGPSFK |
| 9 | CM | NTLSGRSENHSG |
| 10 | CM | NTLSGRSGNHGS |
| 11 | CM | TSTSGRSANPRG |
| 12 | CM | TSGRSANP |
| 13 | CM | VHMPLGFLGP |
| 14 | CM | AVGLLAPP |
| 15 | CM | AQNLLGMV |
| 16 | CM | QNQALRMA |
| 17 | CM | LAAPLGLL |
| 18 | CM | STFPFGMF |
| 19 | CM | ISSGLLSS |
| 20 | CM | PAGLWLDP |
| 21 | CM | VAGRSMRP |
| 22 | CM | VVPEGRRS |
| 23 | CM | ILPRSPAF |
| 24 | CM | MVLGRSLL |
| 25 | CM | QGRAITFI |

TABLE 11-continued Example sequences

| SEQ ID NO. | NAME | SEQUENCE |
|---|---|---|
| 26 | CM | SPRSIMLA |
| 27 | CM | SMLRSMPL |
| 28 | CM | ISSGLLSGRSDNH |
| 29 | CM | AVGLLAPPGGLSGRSDNH |
| 30 | CM | ISSGLLSSGGSGGSLSGRSDNH |
| 31 | CM | LSGRSGNH |
| 32 | CM | SGRSANPRG |
| 33 | CM | LSGRSDDH |
| 34 | CM | LSGRSDIH |
| 35 | CM | LSGRSDQH |
| 36 | CM | LSGRSDTH |
| 37 | CM | LSGRSDYH |
| 38 | CM | LSGRSDNP |
| 39 | CM | LSGRSANP |
| 40 | CM | LSGRSANI |
| 41 | CM | LSGRSDNI |
| 42 | CM | MIAPVAYR |
| 43 | CM | RPSPMWAY |
| 44 | CM | WATPRPMR |
| 45 | CM | FRLLDWQW |
| 46 | CM | ISSGL |
| 47 | CM | ISSGLLS |
| 48 | CM | ISSGLL |
| 49 | CM | ISSGLLSGRSANPRG |
| 50 | CM | AVGLLAPPTSGRSANPRG |
| 51 | CM | AVGLLAPPSGRSANPRG |
| 52 | CM | ISSGLLSGRSDDH |
| 53 | CM | ISSGLLSGRSDIH |
| 54 | CM | ISSGLLSGRSDQH |
| 55 | CM | ISSGLLSGRSDTH |
| 56 | CM | ISSGLLSGRSDYH |
| 57 | CM | ISSGLLSGRSDNP |
| 58 | CM | ISSGLLSGRSANP |
| 59 | CM | ISSGLLSGRSANI |
| 60 | CM | AVGLLAPPGGLSGRSDDH |
| 61 | CM | AVGLLAPPGGLSGRSDIH |
| 62 | CM | AVGLLAPPGGLSGRSDQH |

TABLE 11-continued

Example sequences

| SEQ ID NO. | NAME | SEQUENCE |
|---|---|---|
| 63 | CM | AVGLLAPPGGLSGRSDTH |
| 64 | CM | AVGLLAPPGGLSGRSDYH |
| 65 | CM | AVGLLAPPGGLSGRSDNP |
| 66 | CM | AVGLLAPPGGLSGRSANP |
| 67 | CM | AVGLLAPPGGLSGRSANI |
| 68 | CM | ISSGLLSGRSDNI |
| 69 | CM | AVGLLAPPGGLSGRSDNI |
| 70 | CM | GLSGRSDNHGGAVGLLAPP |
| 71 | CM | GLSGRSDNHGGVHMPLGFLGP |
| 72 | CM | LSGRSDNHGGVHMPLGFLGP |
| 73 | CM | ISSGLSS |
| 74 | CM | PVGYTSSL |
| 75 | CM | DWLYWPGI |
| 76 | CM | LKAAPRWA |
| 77 | CM | GPSHLVLT |
| 78 | CM | LPGGLSPW |
| 79 | CM | MGLFSEAG |
| 80 | CM | SPLPLRVP |
| 81 | CM | RMHLRSLG |
| 82 | CM | LLAPSHRA |
| 83 | CM | GPRSFGL |
| 84 | CM | GPRSFG |
| 85 | CM | SARGPSRW |
| 86 | CM | GGWHTGRN |
| 87 | CM | HTGRSGAL |
| 88 | CM | AARGPAIH |
| 89 | CM | RGPAFNPM |
| 90 | CM | SSRGPAYL |
| 91 | CM | RGPATPIM |
| 92 | CM | RGPA |
| 93 | CM | GGQPSGMWGW |
| 94 | CM | FPRPLGITGL |
| 95 | CM | SPLTGRSG |
| 96 | CM | SAGFSLPA |
| 97 | CM | LAPLGLQRR |
| 98 | CM | SGGPLGVR |
| 99 | CM | PLGL |
| 100 | CM | SGRSDNI |

TABLE 11-continued

Example sequences

| SEQ ID NO. | NAME | SEQUENCE |
| --- | --- | --- |
| 101 | Human Interferon alpha-2a | CDLPQTHSLGSRRTLMLLAQMRKISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEIMRSFSLSTNL QESLRSKE |
| 102 | Rat Interferon alpha-2 | CDLPHTHNLRNKRAFTLLAQMRRLSPVSCLKDRKDFGF PLEKVDGQQIQKAQAIPVLHELTQQILSLFTSKESSTAWD ASLLDSFCNDLQQQLSGLQACLMQQVGVQESPLTQEDS LLAVREYFHRITVYLREKKHSPCAWEVVRAEVWRALSSS ANLLGRLREERNES |
| 103 | Mouse Interferon alpha-2 | CDLPHTYNLRNKRALKVLAQMRRLPFLSCLKDRQDFGF PLEKVDNQQIQKAQAIPVLRDLTQQTLNLFTSKASSAAW NATLLDSFCN DLHQQLNDLQ TCLMQQVGVQ EPPLTQEDAL LAVRKYFHRITVYLREKKHS PCAWEVVRAE VWRALSSSVN LLPRLSEEKE |
| 104 | Human Interferon Alpha-2b | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEIMRSFSLSTNL QESLRSKE |
| 105 | Human Interferon Alpha-n3 | CDLPQTHSLGSRRTLMLLAQMRKISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEIMRSFSLSTNL QESLRSKECDLPQTHSLGSRRTLMLLAQMRRISLFSCLK DRHDFGFPQEEFGNQFQKAETIPVLHEMIQQIFNLFSTKD SSAAWDETLLDKFYTELYQQLNDLEACVIQGVGVTETPL MNEDSILAVRKYFQRITLYLKEKKYSPCAWEVVRAEIMR SFSLSTNLQESLRSKECDLPQTHSLGSRRTLMLLAQMRRI SLFSCLKDRRDFGPQEEFGNQFQKAETIPVLHEMIQQIF NLFSTKDSSAAWDETLLDKFYTELYQQLNDLEACVIQGV GVTETPLMNEDSILAVRKYFQRITLYLKEKKYSPCAWEV VRAEIMRSFSLSTNLQESLRSKE |
| 106 | Human Interferon beta-1a | MSYNLLGFLQRSSNFQCQKLLWQLNGRLEYCLKDRMNF DIPEEIKQLQQFQKEDAALTIYEMLQNIFAIFRQDSSSTGW NETIVENLLANVYHQINHLKTVLEEKLEKEDFTRGKLMS SLHLKRYYGRILHYLKAKEYSHCAWTIVRVEILRNFYFIN RLTGYLRN |
| 107 | Human Interferon beta-1b | SYNLLGFLQRSSNFQSQKLLWQLNGRLEYCLKDRMNFD IPEEIKQLQQFQKEDAALTIYEMLQNIFAIFRQDSSSTGW NETIVENLLANVYHQINHLKTVLEEKLEKEDFTRGKLMS SLHLKRYYGRILHYLKAKEYSHCAWTIVRVEILRNFYFI NRLTGYLRN |
| 108 | Mouse Interferon-Beta | MNNRWILHAAFLLCFSTTALSINYKQLQLQERTNIRKCQ ELLEQLNGKINLTYRADFKIPMEMTEKMQKSYTAFAIQE MLQNVFLVFRNNFSSTGWNETIVVRLLDELHQQTVFLK TVLEEKQEERLTWEMSSTALHLKSYYWRVQRYLKLMK YNSYAWMVVRAEIFRNFLIIRRLTRNFQN |
| 109 | Rat Interferon-Beta | MANRWTLHIAFLLCFSTTALSIDYKQLQFRQSTSIRTCQK LLRQLNGRLNLSYRTDFKIPMEVMHPSQMEKSYTAFAIQ VMLQNVFLVFRSNFSSTGWNETIVESLLDELHQQTELLEI ILKEKQEERLTWVTSTTTLGLKSYYWRVQRYLKDKKYN SYAWMVVRAEVFRNFSIILRLNRNFQN |
| 110 | Human Interferon Omega | MCDLPQNHGLLSRNTLVLLHQMRRISPFLCLKDRRDFRF PQEMVKGSQLQKAHVMSVLHEMQQIFSLFHTERSSAA WNMTLLDQLHTGLHQQLQHLETCLLQVVGEGESAGAIS SPALTLRRYFQGIRVYLKEKKYSDCAWEVVRMEIMKSL FLSTNMQERLRSKDRDLGSS |
| 111 | Human IL-1 alpha | MAKVPDMFEDLKNCYSENEEDSSSIDHLSLNQKSFYHVS YGPLHEGCMDQSVSLSISETSKTSKLTFKESMVVVATNG KVLKKRRLSLSQSITDDDLEAIANDSEEEIIKPRSAPFSFLS NVKYNFMRIIKYEFILNDALNQSIIRANDQYLTAAALHN |

TABLE 11-continued

Example sequences

| SEQ ID NO. | NAME | SEQUENCE |
|---|---|---|
| | | LDEAVKFDMGAYKSSKDDAKITVILRISKTQLYVTAQDE DQPVLLKEMPEIPKTITGSETNLLFFWETHGTKNYFTSVA HPNLFIATKQDYWVCLAGGPPSITDFQILENQA |
| 112 | Mouse IL-1 alpha | MAKVPDLFEDLKNCYSENEDYSSAIDHLSLNQKSFYDAS YGSLHETCTDQFVSLRTSETSKMSNFTFKESRVTVSATSS NGKILKKRRLSFSETFTEDDLQSITHDLEETIQPRSAPYTY QSDLRYKLMKLVRQKFVMNDSLNQTIYQDVDKHYLST TWLNDLQQEVKFDMYAYSSGGDDSKYPVTLKISDSQLF VSAQGEDQPVLLKELPETPKLITGSETDLIFFWKSINSKN YFTSAAYPELFIATKEQSRVHLARGLPSMTDFQIS |
| 113 | Human IL-1 beta | MAEVPELASEMMAYYSGNEDDLFFEADGPKQMKCSFQ DLDLCPLDGGIQLRISDHHYSKGFRQAASVVVAMDKLR KMLVPCPQTFQENDLSTFFPFIFEEEPIFFDTWDNEAYVH DAPVRSLNCTLRDSQQKSLVMSGPYELKALHLQGQDME QQVVFSMSFVQGEESNDKIPVALGLKEKNLYLSCVLKD DKPTLQLESVDPKNYPKKKMEKRFVFNKIEINNKLEFES AQFPNWYISTSQAENMPVFLGGTKGGQDITDFTMQFVSS |
| 114 | Mouse IL-1 beta | MATVPELNCEMPPFDSDENDLFFEVDGPQKMKGCFQTF DLGCPDESIQLQISQQHINKSFRQAVSLIVAVEKLWQLPV SFPWTFQDEDMSTFFSFIFEEEPILCDSWDDDDNLLVCDV PIRQLHYRLRDEQQKSLVLSDPYELKALHLNGQNINQQV IFSMSFVQGEPSNDKIPVALGLKGKNLYLSCVMKDGTPT LQLESVDPKQYPKKKMEKRFVFNKIEVKSKVEFESAEFP NWYISTSQAEHKPVFLGNNSGQDIIDFTMESVSS |
| 115 | Human IL-1 RA | MEICRGLRSHLITLLLFLFHSETICRPSGRKSSKMQAFRIW DVNQKTFYLRNNQLVAGYLQGPNVNLEEKIDVVPIEPH ALFLGIHGGKMCLSCVKSGDETRLQLEAVNITDLSENRK QDKRFAFIRSDSGPTTSFESAACPGWFLCTAMEADQPVS LTNMPDEGVMVTKFYFQEDE |
| 116 | Mouse IL-1 RA | MEICWGPYSHLISLLLILLFHSEAACRPSGKRPCKMQAFR IWDTNQKTFYLRNNQLIAGYLQGPNIKLEEKIDMVPIDL HSVFLGIHGGKLCLSCAKSGDDIKLQLEEVNITDLSKNKE EDKRFTFIRSEKGPTTSFESAACPGWFLCTTLEADRPVSL TNTPEEPLIVTKFYFQEDQ |
| 117 | Human IL-18 | MAAEPVEDNCINFVAMKFIDNTLYFIAEDDENLESDYFG KLESKLSVIRNLNDQVLFIDQGNRPLFEDMTDSDCRDNA PRTIFIISMYKDSQPRGMAVTISVKCEKISTLSCENKIISFK EMNPPDNIKDTKSDIIFFQRSVPGHDNKMQFESSSYEGYF LACEKERDLFKLILKKEDELGDRSIMFTVQNED |
| 118 | Mouse IL-18 | MAAMSEDSCVNFKEMMFIDNTLYFIPEENGDLESDNFG RLHCTTAVIRNINDQVLFVDKRQPVFEDMTDIDQSASEP QTRLIIYMYKDSEVRGLAVTLSVKDSKMSTLSCKNKIISF EEMDPPENIDDIQSDLIFFQKRVPGHNKMEFESSLYEGHF LACQKEDDAFKLILKKKDENGDKSVMFTLTNLHQS |
| 119 | Human IL-2 | MYRMQLLSCIALSLALVTNSAPTSSSTKKTQLQLEHLLL DLQMILNGINNYKNPKLTRMLTFKFYMPKKATELKHLQ CLEEELKPLEEVLNLAQSKNFHLRPRDLISNINVIVLELK GSETTFMCEYADETATIVEFLNRWITFCQSIIS |
| 120 | Mouse IL-2 | MYSMQLASCVTLTLVLLVNSAPTSSSTSSSTAEAQQQQQ QQQQQQQHLEQLLMDLQELLSRMENYRNLKLPRMLTF KFYLPKQATELKDLQCLEDELGPLRHVLDLTQSKSFQLE DAENFISNIRVTVVKLKGSDNTFECQFDDESATVVDFLR RWIAFCQSIISTSPQ |
| 121 | Human IL-4 | MGLTSQLLPPLFFLLACAGNFVHGHKCDITLQEIIKTLNS LTEQKTLCTELTVTDIFAASKNTTEKETFCRAATVLRQF YSHHEKDTRCLGATAQQFHRHKQLIRFLKRLDRNLWGL AGLNSCPVKEANQSTLENFLERLKTIMREKYSKCSS |
| 122 | Mouse IL-4 | MGLNPQLVVILLFFLECTRSHIHGCDKNHLREIIGILNEVT GEGTPCTEMDVPNVLTATKNTTESELVCRASKVLRIFYL KHGKTPCLKKNSSVLMELQRLFRAFRCLDSSISCTMNES KSTSLKDFLESLKSIMQMDYS |
| 123 | Human IL-7 | MFHVSFRYIFGLPPLILVLLPVASSDCDIEGKDGKQYESV LMVSIDQLLDSMKEIGSNCLNNEFNFFKRHICDANKEGM |

TABLE 11-continued

Example sequences

| SEQ ID NO. | NAME | SEQUENCE |
|---|---|---|
|  |  | FLFRAARKLRQFLKMNSTGDFDLHLLKVSEGTTILLNCT GQVKGRKPAALGEAQPTKSLEENKSLKEQKKLNDLCFL KRLLQEIKTCWNKILMGTKEH |
| 124 | Mouse IL-7 | MFHVSFRYIFGIPPLILVLLPVTSSECHIKDKEGKAYESVL MISIDELDKMTGTDSNCPNNEPNFFRKHVCDDTKEAAFL NRAARKLKQFLKMNISEEFNVHLLTVSQGTQTLVNCTS KEEKNVKEQKKNDACFLKRLLREIKTCWNKILKGSI |
| 125 | Human IL-9 | MLLAMVLTSALLLCSVAGQGCPTLAGILDINFLINKMQE DPASKCHCSANVTSCLCLGIPSDNCTRPCFSERLSQMTNT TMQTRYPLIFSRVKKSVEVLKNNKCPYFSCEQPCNQTTA GNALTFLKSLLEIFQKEKMRGMRGKI |
| 126 | Mouse IL-9 | MLVTYILASVLLFSSVLGQRCSTTWGIRDTNYLIENLKD DPPSKCSCSGNVTSCLCLSVPTDDCTTPCYREGLLQLTN ATQKSRLLPVFHRVKRIVEVLKNITCPSFSCEKPCNQTM AGNTLSFLKSLLGTFQKTEMQRQKSRP |
| 127 | Human IL-13 | MHPLLNPLLLALGLMALLLTTVIALTCLGGFASPGPVPPS TALRELIEELVNITQNQKAPLCNGSMVWSINTLTAGMYCA ALESLINVSGCSAIEKTQRMLSGFCPHKVSAGQFSSLHVR DTKIEVAQFVKDLLLHLKKLFREGRFN |
| 128 | Mouse IL-13 | MALWVTAVLALACLGGLAAPGPVPRSVSLPLTLKELIEE LSNITQDQTPLCNGSMVWSVDLAAGGFCVALDSLTNISN CNAIYRTQRILHGLCNRKAPTTVSSLPDTKIEVAHFITKL LSYTKQLFRHGPF |
| 129 | Human IL-15 | MRISKPHLRSISIQCYLCLLLNSHFLTEAGIHVFILGCFSA GLPKTEANWVNVISDLKKIEDLIQSMHIDATLYTESDVH PSCKVTAMKCFLLELQVISLESGDASIHDTVENLIILANN SLSSNGNVTESGCKECEELEEKNIKEFLQSFVHIVQMFIN TS |
| 130 | Mouse IL-15 | MKILKPYMRNTSISCYLCFLLNSHFLTEAGIHVFILGCVS VGLPKTEANWIDVRYDLEKIESLIQSIHIDTTLYTDSDFHP SCKVTAMNCFLLELQVILHEYSNMTLNETVRNVLYLAN STLSSNKNVAESGCKECEELEEKTFTEFLQSFIRIVQMFIN TS |
| 131 | Human IL-3 | MSRLPVLLLLQLLVRPGLQAPMTQTTPLKTSWVNCSNM IDEIITHLKQPPLPLLDFNNLNGEDQDILMENNLRRPNLE AFNRAVKSLQNASAIESILKNLLPCLPLATAAPTRHPIHIK DGDWNEFRRKLTFYLKTLENAQAQQTTLSLAIF |
| 132 | Mouse IL-3 | MVLASSTTSIHTMLLLLLMLFHLGLQASISGRDTHRLTRT LNCSSIVKEIIGKLPEPELKTDDEGPSLRNKSFRRVNLSKF VESQGEVDPEDRYVIKSNLQKLNCCLPTSANDSALPGVF IRDLDDFRKKLRFYMVHLNDLETVLTSRPPQPASGSVSP NRGTVEC |
| 133 | Human IL-5 | MRMLLHLSLLALGAAYVYAIPTEIPTSALVKETLALLST HRTLLIANETLRIPVPVHKNHQLCTEEIFQGIGTLESQTVQ GGTVERLFKNLSLIKKYIDGQKKKCGEERRRVNQFLDYL QEFLGVMNTEWIIES |
| 134 | Mouse IL-5 | MRRMLLHLSVLTLSCVWATAMEIPMSTVVKETLTQLSA HRALLTSNETMRLPVPTHKNHQLCIGEIFQGLDILKNQT VRGGTVEMLFQNLSLIKKYIDRQKEKCGEERRRTRQFLD YLQEFLGVMSTEWAMEG |
| 135 | Human GM-CSF | MWLQSLLLLGTVACSISAPARSPSPSTQPWEHVNAIQEA RRLLNLSRDTAAEMNETVEVISEMFDLQEPTCLQTRLEL YKQGLRGSLTKLKGPLTMMASHYKQHCPPTPETSCATQI ITFESFKENLKDFLLVIPFDCWEPVQE |
| 136 | Mouse GM-CSF | MWLQNLLFLGIVVYSLSAPTRSPITVTRPWKHVEAIKEA LNLLDDMPVTLNEEVEVVSNEFSFKKLTCVQTRLKIFEQ GLRGNFTKLKGALNMTASYYQTYCPPTPETDCETQVTT YADFIDSLKTFLTDIPFECKKPGQK |
| 137 | Human IL-6 | MNSFSTSAFGPVAFSLGLLLVLPAAFPAPVPPGEDSKDV AAPHRQPLTSSERIDKQIRYILDGISALRKETCNKSNMCE SSKEALAENNLNLPKMAEKDGCFQSGFNEETCLVKIITG |

TABLE 11-continued

Example sequences

| SEQ ID NO. | NAME | SEQUENCE |
|---|---|---|
| | | LLEFEVYLEYLQNRFESSEEQARAVQMSTKVLIQFLQKK AKNLDAITTPDPTTNASLLTKLQAQNQWLQDMTTHLILR SFKEFLQSSLRALRQM |
| 138 | Mouse IL-6 | MKFLSARDFHPVAFLGLMLVTTTAFPTSQVRRGDFTEDT TPNRPVYTTSQVGGLITHVLWEIVEMRKELCNGNSDCM NNDDALAENNLKLPEIQRNDGCYQTGYNQEICLLKISSG LLEYHSYLEYMKNNLKDNKKDKARVLQRDTETLIHIFN QEVKDLHKIVLPTPISNALLTDKLESQKEWLRTKTIQFIL KSLEEFLKVTLRSTRQT |
| 139 | Human IL-11 | MNCVCRLVLVVLSLWPDTAVAPGPPPGPPRVSPDPRAEL DSTVLLTRSLLADTRQLAAQLRDKFPADGDHNLDSLPTL AMSAGALGALQLPGVLTRLRADLLSYLRHVQWLRRAG GSSLKTLEPELGTLQARLDRLLRRLQLLMSRLALPQPPPD PPAPPLAPPSSAWGGIRAAHAILGGLHLTLDWAVRGLLL LKTRL |
| 140 | Mouse IL-11 | MNCVCRLVLVVLSLWPDRVVAPGPPAGSPRVSSDPRAD LDSAVLLTRSLLADTRQLAAQMRDKFPADGDHSLDSLP TLAMSAGTLGSLQLPGVLTRLRVDLMSYLRHVQWLRR AGGPSLKTLEPELGALQARLERLLRRLQLLMSRLALPQA APDQPVIPLGPPASAWGSIRAAHAILGGLHLTLDWAVRG LLLLKTRL |
| 141 | Human G-CSF | MAGPATQSPMKLMALQLLLWHSALWTVQEATPLGPAS SLPQSFLLKCLEQVRKIQGDGAALQEKLVSECATYKLCH PEELVLLGHSLGIPWAPLSSCPSQALQLAGCLSQLHSGLF LYQGLLQALEGISPELGPTLDTLQLDVADFATTIWQQME ELGMAPALQPTQGAMPAFASAFQRRAGGVLVASHLQSF LEVSYRVLRHLAQP |
| 142 | Mouse G-CSF | MAQLSAQRRMKLMALQLLLWQSALWSGREAVPLVTVS ALPPSLPLPRSFLLKSLEQVRKIQASGSVLLEQLCATYKL CHPEELVLLGHSLGIPKASLSGCSSQALQQTQCLSQLHSG LCLYQGLLQALSGISPALAPTLDLLQLDVANFATTIWQQ MENLGVAPTVQPTQSAMPAFTSAFQRRAGGVLAISYLQ GFLETARLALHHLA |
| 143 | Human IL-12 alpha | MCPARSLLLVATLVLLDHLSLARNLPVATPDPGMFPCLH HSQNLLRAVSNMLQKARQTLEFYPCTSEEIDHEDITKDK TSTVEACLPLELTKNESCLNSRETSFITNGSCLASRKTSF MMALCLSSIYEDLKMYQVEFKTMNAKLLMDPKRQIFLD QNMLAVIDELMQALNFNSETVPQKSSLEEPDFYKTKIKL CILLHAFRIRAVTIDRVMSYLNAS |
| 144 | Human IL-12 beta | MCHQQLVISWFSLVFLASPLVAIWELKKDVYVVELDWY PDAPGEMVVLTCDTPEEDGITWTLDQSSEVLGSGKTLTI QVKEFGDAGQYTCHKGGEVLSHSLLLLHKKEDGIWSTD ILKDQKEPKNKTFLRCEAKNYSGRFTCWWLTTISTDLTF SVKSSRGSSDPQGVTCGAATLSAERVRGDNKEYEYSVE CQEDSACPAAEESLPIEVMVDAVHKLKYENYTSSFFIRDI IKPDPPKNLQLKPLKNSRQVEVSWEYPDTWSTPHSYFSL TFCVQVQGKSKREKKDRVFTDKTSATVICRKNASISVRA QDRYYSSSWSEWASVPCS |
| 145 | Mouse IL-12 beta | MCPQKLTISWFAIVLLVSPLMAMWELEKDVYVVEVDW TPDAPGETVNLTCDTPEEDDITWTSDQRHGVIGSGKTLTI TVKEFLDAGQYTCHKGGETLSHSHLLLHKKENGIWSTEI LKNFKNKTFLKCEAPNYSGRFTCSWLVQRNMDLKFNIK SSSSSPDSRAVTCGMASLSAEKVTLDQRDYEKYSVSCQE DVTCPTAEETLPIELALEARQQNKYENYSTSFFIRDIIKPD PPKNLQMKPLKNSQVEVSWEYPDSWSTPHSYFSLKFFV RIQRKKEKMKETEEGCNQKGAFLVEKTSTEVQCKGGNV CVQAQDRYYNSSCSKWACVPCRVRS |
| 146 | Mouse IL-12 alpha | MCQSRYLLFLATLALLNHLSLARVIPVSGPARCLSQSRN LLKTTDDMVKTAREKLKHYSCTAEDIDHEDITRDQTSTL KTCLPLELHKNESCLATRETSSTTRGSCLPPQKTSLMMT LCLGSIYEDLKMYQTEFQAINAALQNHNHQQIILDKGML VAIDELMQSLNHNGETLRQKPPVGEADPYRVKMKLCIL LHAFSTRVVTINRVMGYLSSA |
| 147 | Human LIF | MKVLAAGVVPLLLVLHWKHGAGSPLPITPVNATCAIRH PCHNNLMNQIRSQLAQLNGSANALFILYYTAQGEPFPNN |

TABLE 11-continued

Example sequences

| SEQ ID NO. | NAME | SEQUENCE |
|---|---|---|
| | | LDKLCGPNVTDFPPFHANGTEKAKLVELYRIVVYLGTSL GNITRDQKILNPSALSLHSKLNATADILRGLLSNVLCRLC SKYHVGHVDVTYGPDTSGKDVFQKKKLGCQLLGKYKQ IIAVLAQAF |
| 148 | Mouse LIF | MKVLAAGIVPLLLLVLHWKHGAGSPLPITPVNATCAIRH PCHGNLMNQIKNQLAQLNGSANALFISYYTAQGEPFPNN VEKLCAPNMTDFPSFHGNGTEKTKLVELYRMVAYLSAS LTNITRDQKVLNPTAVSLQVKLNATIDVMRGLLSNVLCR LCNKYRVGHVDVPPVPDHSDKEAFQRKKLGCQLLGTY KQVISVVVQAF |
| 149 | Human OSM | MGVLLTQRTLLSLVLALLFPSMASMAAIGSCSKEYRVLL GQLQKQTDLMQDTSRLLDPYIRIQGLDVPKLREHCRERP GAFPSEETLRGLGRRGFLQTLNATLGCVLHRLADLEQRL PKAQDLERSGLNIEDLEKLQMARPNILGLRNNIYCMAQL LDNSDTAEPTKAGRGASQPPTPTPASDAFQRKLEGCRFL HGYHRFMHSVGRVFSKWGESPNRSRRHSPHQALRKGV RRTRPSRKGKRLMTRGQLPR |
| 150 | Mouse OSM | MQTRLLRTLLSLTLSLLILSMALANRGCSNSSSQLLSQLQ NQANLTGNTESLLEPYIRLQNLNTPDLRAACTQHSVAFP SEDTLRQLSKPHFLSTVYTTLDRVLYQLDALRQKFLKTP AFPKLDSARHNILGIRNNVFCMARLLNHSLEIPEPTQTDS GASRSTTTPDVFNTKIGSCGFLWGYHRFMGSVGRVFRE WDDGSTRSRRQSPLRARRKGTRRIRVRHKGTRRIRVRRK GTRRIWVRRKGSRKIRPSRSTQSPTTRA |
| 151 | Human IL-10 | MHSSALLCCLVLLTGVRASPGQGTQSENSCTHFPGNLPN MLRDLRDAFSRVKTFFQMKDQLDNLLLKESLLEDFKGY LGCQALSEMIQFYLEEVMPQAENQDPDIKAHVNSLGEN LKTLRLRLRRCHRFLPCENKSKAVEQVKNAFNKLQEKGI YKAMSEFDIFINYIEAYMTMKIRN |
| 152 | Mouse IL-10 | MPGSALLCCLLLLTGMRISRGQYSREDNNCTHFPVGQSH MLLELRTAFSQVKTFFQTKDQLDNILLTDSLMQDFKGYL GCQALSEMIQFYLVEVMPQAEKHGPEIKEHLNSLGELK TLRMRLRRCHRFLPCENKSKAVEQVKSDFNKLQDQGVY KAMNEFDIFINCIEAYMMIKMKS |
| 153 | Human IL-20 | MKASSLAFSLLSAAFYLLWTPSTGLKTLNLGSCVIATNL QEIRNGFSEIRGSVQAKDGNIDIRILRRTESLQDTKPANRC CLLRHLLRLYLDRVFKNYQTPDHYTLRKISSLANSFLTIK KDLRLCHAHMTCHCGEEAMKKYSQILSHFEKLEPQAAV VKALGELDILLQWMEETE |
| 154 | Mouse IL-20 | MKGFGLAFGLFSAVGFLLWTPLTGLKTLHLGSCVITANL QAIQKEFSEIRDSVQAEDTNIDIRILRTTESLKDIKSLDRC CFLRHLVRFYLDRVFKVYQTPDHHTLRKISSLANSFLIIK KDLSVCHSHMACHCGEEAMEKYNQILSHFIELELQAAV VKALGELGILLRWMEEML |
| 155 | Human IL-14 | MKNQDKKNGAAKQSNPKSSPGQPEAGPEGAQERPSQA APAVEAEGPGSSQAPRKPEGAQARTAQSGALRDVSEELS RQLEDILSTYCVDNNQGGPGEDGAQGEPAEPEDAEKSRT YVARNGEPEPTPVVNGEKEPSKGDPNTEEIRQSDEVGDR DHRRPQEKKKAKGLGKEITLLMQTLNTLSTPEEKLAALC KKYAELLEEHRNSQKQMKLLQKKQSQLVQEKDHLRGE HSKAVLARSKLESLCRELQRHNRSLKEEGVQRAREEEEK RKEVTSHFQVTLNDIQLQMEQHNERNSKLRQENMELAE RLKKLIEQYELREEHIDKVFKHKDLQQQLVDAKLQQAQ EMLKEAEEERHQREKDFLLKEAVESQRMCELMKQQETH LKQQLALYTEKFEEFQNTLSKSSEVFTTFKQEMEKMTKK IKKLEKETTMYRSRWESSNKALLEMAEEKTVRDKELEG LQVKIQRLEKLCRALQTERNDLNKRVQDLSAGGQGSLT DSGPERRPEGPGAQAPSSPRVTEAPCYPGAPSTEASGQT GPQEPTSARA |
| 156 | Mouse IL-14 | MKNQDKKNGPAKHSNSKGSPGQREAGPEGAHGRPRQT APGAEAEGSTSQAPGKTEGARAKAAPGALCDVSEELS RQLEDILSTYCVDNNQGGPAEEGAQGEPTEPEDTEKSRT YAARNGEPEPGIPVVNGEKETSKGEPGTEEIRASDEVGD RDHRRPQEKKKAKGLGKEITLLMQTLNTLSTPEEKLAAL CKKYAELLEEHRNSQKQMKLLQKKQSQLVQEKDHLRG EHSKAVLARSKLESLCRELQRHNRSLKEEGVQRAREEEE |

TABLE 11-continued

Example sequences

| SEQ ID NO. | NAME | SEQUENCE |
|---|---|---|
| | | KRKEVTSHFQVTLNDIQLQMEQHNERNSKLRQENMELA ERLKKLIEQYELREEHIDKVFKHKDLQQQLVDAKLQQA QEMLKEAEERHQREKEFLLKEAVESQRMCELMKQQET HLKQQLALYTEKFEEFQNTLSKSSEVFTTFKQEMEKMTK KIKKLEKETTMYRSRWESSNKALLEMAEEKTVRDKELE GLQVKIQRLEKLCRALQTERNDLNKRVQDLTAGGITDIG SERRPEATTASKEQGVESPGAQPASSPRATDAPCCSGAPS TGTAGQTGPGEPTPATA |
| 157 | Human IL-16 | MESHSRAGKSRKSAKFRSISRSLMLCNAKTSDDGSSPDE KYPDPFEISLAQGKEGIFHSSVQLADTSEAGPSSVPDLAL ASEAAQLQAAGNDRGKTCRRIFFMKESSTASSREKPGKL EAQSSNFLFPKACHQRARSNSTSVNPYCTREIDFPMTKK SAAPTDRQPYSLCSNRKSLSQQLDCPAGKAAGTSRPTRS LSTAQLVQPSGGLQASVISNIVLMKGQAKGLGFSIVGGK DSIYGPIGIYVKTIFAGGAAAADGRLQEGDEILELNGESM AGLTHQDALQKFKQAKKGLLTLTVRTRLTAPPSLCSHLS PPLCRSLSSSTCITKDSSSFALESPSAPISTAKPNYRIMVEV SLQKEAGVGLGIGLCSVPYFQCISGIFVHTLSPGSVAHLD GRLRCGDEIVEISDSPVHCLTLNEVYTILSHCDPGPVPIIV SRHPDPQVSEQQLKEAVAQAVENTKFGKERHQWSLEGV KRLESSWHGRPTLEKEREKNSAPPHRRAQKVMIRSSSDS SYMSGSPGGSPGSGSAEKPSSDVDISTHSPSLPLAREPVV LSIASSRLPQESPPLPESRDSHPPLRLKKSFEIVRKPMSSKP KPPPRKYFKSDSDPQKSLEERENSSCSSGHTPPTCGQEAR ELLPLLLPQEDTAGRSPSASAGCPGPGIGPQTKSSTEGEP GWRRASPVTQTSPIKHPLLKRQARMDYSFDTTAEDPWV RISDCIKNLFSPIMSENHGHMPLQPNASLNEEEGTQGHPD GTPPKLDTANGTPKVYKSADSSTVKKGPPVAPKPAWFR QSLKGLRNRASDPRGLPDPALSTQPAPASREHLGSHIRAS SSSSSIRQRISSFETFGSSQLPDKGAQRLSLQPSSGEAAKP LGKHEEGRFSGLLRGAAPTLVPQQPEQVLSSGSPAASE ARDPGVSESPPPGRQPNQKTLPPGPDPLLRLLSTQAEESQ GPVLKMPSQRARSFPLTRSQSCETKLLDEKTSKLYSISSQ VSSAVMKSLLCLPSSISCAQTPCIPKEGASPTSSSNEDSAA NGSAETSALDTGFSLNLSELREYTEGLTEAKEDDDGDHS SLQSGQSVISLLSSEELKKLIEEVKVLDEATLKQLDGIHV TILHKEEGAGLGFSLAGGADLENKVITVHRVFPNGLASQ EGTIQKGNEVLSINGKSLKGTTHHDALAILRQAREPRQA VIVTRKLTPEAMPDLNSSTDSAASASAASDVSVESTAEA TVCTVTLEKMSAGLGFSLEGGKGSLHGDKPLTINRIFKG AASEQSETVQPGDEILQLGGTAMQGLTRFEAWNIIKALP DGPVTIVIRRKSLQSKETTAAGDS |
| 158 | Mouse IL-16 | MEPHGHSGKSRKSTKFRSISRSLILCNAKTSDDGSSPDEK YPDPFETSLCQGKEGFFHSSMQLADTFEAGLSNIPDLALA SDSAQLAAAGSDRGKHCRKMFFMKESSSTSSKEKSGKP EAQSSSFLFPKACHQRTRSNSTSVNPYSAGEIDFPMTKKS AAPTDRQPYSLCSNRKSLSQQLDYPILGTARPTRSLSTAQ LGQLSGGLQASVISNIVLMKGQAKGLGFSIVGGKDSIYG PIGIYVKSIFAGGAAAADGRLQEGDEILELNGESMAGLT HQDALQKFKQAKKGLLTLTVRTRLTTPPSLCSHLSPPLC RSLSSSTCGAQDSSPFSLESPASPASTAKPNYRIMVEVSL KKEAGVGLGIGLCSIPYFQCISGIFVHTLSPGSVAHLDGR LRCGDEIVEINDSPVHCLTLNEVYTILSHCDPGPVPIIVSR HPDPQVSEQQLKEAVAQAVEGVKFGKDRHQWSLEGVK RLESSWHGRPTLEKEREKHSAPPHRRAQKIMVRSSSDSS YMSGSPGGSPCSAGAEPQPSEREGSTHSPSLSPGEEQEPC PGVPSRPQQESPPLPESLERESHPPLRLKKSFEILVRKPTSS KPKPPPRKYFKNDSEPQKKLEEKEKVTDPSGHTLPTCSQ ETRELLPLLLQEDTAGRAPCTAACCPGPAASTQTSSSTEG ESRRSASPETPASPGKHPLLKRQARMDYSFDITAEDPWV RISDCIKNLFSPIMSENHSHTPLQPNTSLGEEDGTQGCPEG GLSKMDAANGAPRVYKSADGSTVKKGPPVAPKPAWFR QSLKGLRNRAPDPRRPPEVASAIQPTPVSRDPPGPQPQAS SSIRQRISSFENFGSSQLPDRGVQRLSLQPSSGETTKFPGK QDGGRFSGLLGQGATVTAKHRQTEVESMSTTFPNSSEV RDPGLPESPPPGQRPSTKALSPDPLLRLLTTQSEDTQGPG LKMPSQRARSFPLTRTQSCETKLLDEKASKLYSISSQLSS AVMKSLLCLPSSVSCGQITCIPKERVSPKSPCNNSSAAEG FGEAMASDTGFSLNLSELREYSEGLTEPGETEDRNHCSS QAGQSVISLLSAEELEKLIEEVRVLDEATLKQLDSIHVTIL HKEEGAGLGFSLAGGADLENKVITVHRVFPNGLASQEG TIQKGNEVLSINGKSLKGATHNDALAILRQARDPRQAVI VTRRTTVEATHDLNSSTDSAASASAASDISVESKEATVC |

TABLE 11-continued

Example sequences

| SEQ ID NO. | NAME | SEQUENCE |
|---|---|---|
| | | TVTLEKTSAGLGFSLEGGKGSLHGDKPLTINRIFKGTEQG EMVQPGDEILQLAGTAVQGLTRFEAWNVIKALPDGPVTI VIRRTSLQCKQTTASADS |
| 159 | Human IL-17 | MTPGKTSLVSLLLLLSLEAIVKAGITIPRNPGCPNSEDKNF PRTVMVNLNIHNRNTNTNPKRSSDYYNRSTSPWNLHRN EDPERYPSVIWEAKCRHLGCINADGNVDYHMNSVPIQQ EILVLRREPPHCPNSFRLEKILVSVGCTCVTPIVHHVA |
| 160 | Mouse IL-17 | MSPGRASSVSLMLLLLLSLAATVKAAAIIPQSSACPNTEA KDFLQNVKVNLKVFNSLGAKVSSRRPSDYLNRSTSPWT LHRNEDPDRYPSVIWEAQCRHQRCVNAEGKLDHHMNS VLIQQEILVLKREPESCPFTFRVEKMLVGVGCTCVASIVR QAA |
| 161 | Human CD154 | MIETYNQTSPRSAATGLPISMKIFMYLLTVFLITQMIGSA LFAVYLHRRLDKIEDERNLHEDFVFMKTIQRCNTGERSL SLLNCEEIKSQFEGFVKDIMLNKEETKKENSFEMQKGDQ NPQIAAHVISEASSKTTSVLQWAEKGYYTMSNNLVTLEN GKQLTVKRQGLYYIYAQVTFCSNREASSQAPFIASLCLK SPGRFERILLRAANTHSSAKPCGQQSIHLGGVFELQPGAS VFVNVTDPSQVSHGTGFTSFGLLKL |
| 162 | Mouse CD154 | MIETYSQPSPRSVATGLPASMKIFMYLLTVFLITQMIGSV LFAVYLHRRLDKVEEEVNLHEDFVFIKKLKRCNKGEGSL SLLNCEEMRRQFEDLVKDITLNKEEKKENSFEMQRGDE DPQIAAHVVSEANSNAASVLQWAKKGYYTMKSNLVML ENGKQLTVKREGLYYVYTQVTFCSNREPSSQRPFIVGLW LKPSSGSERILLKAANTHSSSQLCEQQSVHLGGVFELQA GASVFVNVTEASQVIHRVGFSSFGLLKL |
| 163 | Human LT-beta | MGALGLEGRGGRLQGRGSLLLAVAGATSLVTLLLAVPI TVLAVLALVPQDQGGLVTETADPGAQAQQGLGFQKLPE EEPETDLSPGLPAAHLIGAPLKGQGLGWETTKEQAFLTS GTQFSDAEGLALPQDGLYYLYCLVGYRGRAPPGGGDPQ GRSVTLRSSLYRAGGAYGPGTPELLLEGAETVTPVLDPA RRQGYGPLWYTSVGFGGLVQLRRGERVYVNISHPDMV DFARGKTFFGAVMVG |
| 164 | Mouse LT-beta | MGTRGLQGLGGRPQGRGCLLLAVAGATSLVTLLLAVPI TVLAVLALVPQDQGRRVEKIIGSGAQAQKRLDDSKPSCI LPSPSSLSETPDPRLHPQRSNASRNLASTSQGPVAQSSRE ASAWMTILSPAADSTPDPGVQQLPKGEPETDLNPELPAA HLIGAWMSGQGLSWEASQEEAFLRSGAQFSPTHGLALP QDGVYYLYCHVGYRGRTPPAGRSRARSLTLRSALYRAG GAYGRGSPELLLEGAETVTPVVDPIGYGSLWYTSVGFGG LAQLRSGERVYVNISHPDMVDYRRGKTFFGAVMVG |
| 165 | Human TNF-alpha | STESMIRDVELAEEEALPKKTGGPQGSRRCLFLSLFSFLIV AGATTLFCLLHFGVIGPQREEFPRDLSLISPLAQAVRSSSR TPSDKPVAHVVANPQAEGQLQWLNRRANALLANGVEL RDNQLVVPSEGLYLIYSQVLFKGQGCPSTHVLLTHTISRI AVSYQTKVNLLSAIKSPCQRETPEGAEAKPWYEPIYLGG VFQLEKGDRLSAEINRPDYLDFAESGQVYFGIIAL |
| 166 | Mouse TNF-alpha | NHQVEEQLEWLSQRANALLANGMDLKDNQLVVPADGL YLVYSQVLFKGQGCPDYVLLTHTVSRFAISYQEKVNLLS AVKSPCPKDTPEGAELKPWYEPIYLGGVFQLEKGDQLSA EVNLPKYLDFAESGQVYFGVIAL |
| 167 | Human TNF-beta | MTPPERLFLPRVCGTTLHLLLLGLLLVLLPGAQGLPGVG LTPSAAQTARQHPKMHLAHSTLKPAAHLIGDPSKQNSLL WRANTDRAFLQDGFSLSNNSLLVPTSGIYFVYSQVVFSG KAYSPKATSSPLYLAHEVQLFSSQYPFHVPLLSSQKMVY PGLQEPWLHSMYHGAAFQLTQGDQLSTHTDGIPHLVLS PSTVFFGAFAL |
| 168 | Human 4-1BBL | MEYASDASLDPEAPWPPAPRARACRVLPWALVAGLLLL LLLAAACAVFLACPWAVSGARASPGSAASPRLREGPELS PDDPAGLLDLRQGMFAQLVAQNVLLIDGPLSWYSDPGL AGVSLTGGLSYKEDTKELVVAKAGVYYVFFQLELRRVV AGEGSGSVSLALHLQPLRSAAGAAALALTVDLPPASSEA RNSAFGFQGRLLHLSAGQRLGVHLHTEARARHAWQLT QGATVLGLFRVTPEIPAGLPSPRSE |

TABLE 11-continued

Example sequences

| SEQ ID NO. | NAME | SEQUENCE |
|---|---|---|
| 169 | Mouse 4-1BBL | MDQHTLDVEDTADARHPAGTSCPSDAALLRDTGLLADA ALLSDTVRPTNAALPTDAAYPAVNVRDREAAWPPALNF CSRHPKLYGLVALVLLLIAACVPIFTRTEPRPALTITTSP NLGTRENNADQVTPVSHIGCPNTTQQGSPVFAKLLAKN QASLCNTTLNWHSQDGAGSSYLSQGLRYEEDKKELVVD SPGLYYVFLELKLSPTFTNTGHKVQGWVSLVLQAKPQV DDFDNLALTVELFPCSMENKLVDRSWSQLLLLKAGHRL SVGLRAYLHGAQDAYRDWELSYPNTTSFGLFLVKPDNP WE |
| 170 | Human APRIL | AVLTQKQKKQHSVLHLVPINATSKDDSDVTEVMWQPA LRRGRGLQAQGYGVRIQDAGVYLLYSQVLFQDVTFTM GQVVSREGQGRQETLFRCIRSMPSHPDRAYNSCYSAGVF HLHQGDILSVIIPRARAKLNLSPHGTFLGFVKL |
| 171 | Mouse APRIL | MPASSPGHMGGSVREPALSVALWLSWGAVLGAVTCAV ALLIQQTELQSLRREVSRLQRSGGPSQKQGERPWQSLWE QSPDVLEAWKDGAKSRRRRAVLTQKHKKKHSVLHLVP VNITSKADSDVTEVMWQPVLRRGRGLEAQGDIVRVWD TGIYLLYSQVLFHDVTFTMGQVVSREGQGRRETLFRCIR SMPSDPDRAYNSCYSAGVFHLHQGDIITVKIPRANAKLS LSPHGTFLGFVKL |
| 172 | Human CD70 | MPEEGSGCSVRRRPYGCVLRAALVPLVAGLVICLVVCIQ RFAQAQQQLPLESLGWDVAELQLNHTGPQQDPRLYWQ GGPALGRSFLHGPELDKQLRIHRDGIYMVHIQVTLAICS STTASRHHPTTLAVGICSPASRSISLLRLSFHQGCTIASQR LTPLARGDTLCTNLTGTLLPSRNTDETFFGVQWVRP |
| 173 | Mouse CD70 | MPEEGRPCPWVRWSGTAFQRQWPWLLLVVFITVFCCW FHCSGLLSKQQQRLLEHPEPHTAELQLNLTVPRKDPTLR WGAGPALGRSFTHGPELEEGHLRIHQDGLYRLHIQVTLA NCSSPGSTLQHRATLAVGICSPAAHGISLLRGRFGQDCTV ALQRLTYLVHGDVLCTNLTLPLLPSRNADETFFGVQWIC P |
| 174 | Human CD153 | MDPGLQQALNGMAPPGDTAMHVPAGSVASHLGTTSRS YFYLTTATLALCLVFTVATIMVLVVQRTDSIPNSPDNVPL KGGNCSEDLLCILKRAPFKKSWAYLQVAKHLNKTKLSW NKDGILHGVRYQDGNLVIQFPGLYFIICQLQFLVQCPNNS VDLKLELLINKHIKKQALVTVCESGMQTKHVYQNLSQF LLDYLQVNTTISVNVDTFQYIDTSTFPLENVLSIFLYSNSD |
| 175 | Mouse CD153 | MEPGLQQAGSCGAPSPDPAMQVPGSVASPWRSTRPWR STSRSYFYLSTTALVCLVVAVAIILVLVVQKKDSTPNTTE KAPLKGGNCSEDLFCTLKSTPSKKSWAYLQVSKHLNNT KLSWNEDGTIHGLIYQDGNLIVQFPGLYFIVCQLQFLVQ CSNHSVDLTLQLLINSKIKKQTLVTVCESGVQSKNIYQNL SQFLLHYLQVNSTISVRVDNFQYVDTNTFPLDNVLSVFL YSSSD |
| 176 | Human CD178 | MQQPFNYPYPQIYWVDSSASSPWAPPGTVLPCPTSVPRR PGQRRPPPPPPPPLPPPPPPPPLPPLPLPPLKKRGNHSTGL CLLVMFFMVLVALVGLGLGMFQLFHLQKELAELRESTS QMHTASSLEKQIGHPSPPPEKKELRKVAHLTGKSNSRSM PLEWEDTYGIVLLSGVKYKKGGLVINETGLYFVYSKVYF RGQSCNNLPLSHKVYMRNSKYPQDLVMMEGKMMSYC TTGQMWARSSYLGAVFNLTSADHLYVNVSELSLVNFEE SQTFFGLYKL |
| 177 | Mouse CD178 | MQQPMNYPCPQWWVDSSATSSWAPPGSVFPCPSCGPRG PDQRRPPPPPPPVSPLPPPSQPLPLPPLTPLKKKDHNTNLW LPVVFFMVLVALVGMGLGMYQLFHLQKELAELREFTN QSLKVSSFEKQIANPSTPSEKKEPRSVAHLTGNPHSRSIPL EWEDTYGTALISGVKYKKGGLVINETGLYFVYSKVYFR GQSCNNQPLNHKVYMRNSKYPEDLVLMEEKRLNYCTT GQIWAHSSYLGAVFNLTSADHLYVNISQLSLINFEESKTF FGLYKL |
| 178 | Human GITRL | MTLHPSPITCEFLFSTALISPKMCLSHLENMPLSHSRTQG AQRSSWKLWLFCSIVMLLFLCSFSWLIFIFLQLETAKEPC MAKFGPLPSKWQMASSEPPCVNKVSDWKLEILQNGLYL IYGQVAPNANYNDVAPFEVRLYKNKDMIQTLTNKSKIQ NVGGTYELHVGDTIDLIFNSEHQVLKNNTYWGIILLANP QFIS |

TABLE 11-continued

Example sequences

| SEQ ID NO. | NAME | SEQUENCE |
|---|---|---|
| 179 | Mouse GITRL | MEEMPLRESSPQRAERCKKSWLLCIVALLLMLLCSLGTL IYTSLKPTAIESCMVKFELSSSKWHMTSPKPHCVNTTSD GKLKILQSGTYLIYGQVIPVDKKYIKDNAPFVVQIYKKN DVLQTLMNDFQILPIGGVYELHAGDNIYLKFNSKDHIQK TNTYWGIILMPDLPFIS |
| 180 | Human LIGHT | MEESVVRPSVFVVDGQTDIPFTRLGRSHRRQSCSVARVG LGLLLLLMGAGLAVQGWFLLQLHWRLGEMVTRLPDGP AGSWEQLIQERRSHEVNPAAHLTGANSSLTGSGGPLLW ETQLGLAFLRGLSYHDGALVVTKAGYYYIYSKVQLGGV GCPLGLASTITHGLYKRTPRYPEELELLVSQQSPCGRATS SSRVWWDSSFLGGVVHLEAGEKVVVRVLDERLVRLRD GTRSYFGAFMV |
| 181 | Mouse LIGHT | MESVVQPSVFVVDGQTDIPFRRLEQNHRRRCGTVQVS LALVLLLLGAGLATQGWFLLRLHQRLGDIVAHLPDGGKG SWEKLIQDQRSHQANPAAHLTGANASLIGIGGPLLWETR LGLAFLRGLTYHDGALVTMEPGYYYVYSKVQLSGVGCP QGLANGLPITHGLYKRTSRYPKELELLVSRRSPCGRANS SRVWWDSSFLGGVVHLEAGEEVVVRVPGNRLVRPRDG TRSYFGAFMV |
| 182 | Human OX40L | MERVQPLEENVGNAARPRFERNKLLLVASVIQGLGLLLC FTYICLHFSALQVSHRYPRIQSIKVQFTEYKKEKGFILTSQ KEDEIMKVQNNSVIINCDGFYLISLKGYFSQEVNISLHYQ KDEEPLFQLKKVRSVNSLMVASLTYKDKVYLNVTTDNT SLDDFHVNGGELILIHQNPGEFCVL |
| 183 | Mouse OX40L | MEGEGVQPLDENLENGSRPRFKWKKTLRLVVSGIKGAG MLLCFIYVCLQLSSSPAKDPPIQRLRGAVTRCEDGQLFIS SYKNEYQTMEVQNNSVVIKCDGLYIIYLKGSFFQEVKID LHFREDHNPISIPMLNDGRRIVFTVVASLAFKDKVYLTV NAPDTLCEHLQINDGELIVVQLTPGYCAPEGSYHSTVNQ VP |
| 184 | Human TALL-1 | MDDSTEREQSRLTSCLKKREEMKLKECVSILPRKESPSV RSSKDGKLLAATLLLALLSCCLTVVSFYQVAALQGDLAS LRAELQGHHAEKLPAGAGAPKAGLEEAPAVTAGLKIFEP PAPGEGNSSQNSRNKRAVQGPEETVTQDCLQLIADSETP TIQKGSYTFVPWLLSFKRGSALEEKENKILVKETGYFFIY GQVLYTDKTYAMGHLIQRKKVHVFGDELSLVTLFRCIQ NMPETLPNNSCYSAGIAKLEEGDELQLAIPRENAQISLDG DVTFFGALKLL |
| 185 | Mouse TALL-1 | MAMAFCPKDQYWDSSRKSCVSCALTCSQRSQRTCTDFC KFINCRKEQGRYYDHLLGACVSCDSTCTQHPQQCAHFC EKRPRSQANLQPELGRPQAGEVEVRSDNSGRHQGSEHG PGLRLSSDQLTLYCTLGVCLCAIFCCFLVALASFLRRRGE PLPSQPAGPRGSQANSPHAHRPVTEACDEVTASPQPVET CSFCFPERSSPTQESAPRSLGIHGFAGTAAPQPCMRATVG GLGVLRASTGDARPAT |
| 186 | Human TRAIL | MAMMEVQGGPSLGQTCVLIVIFTVLLQSLCVAVTYVYF TNELKQMQDKYSKSGIACFLKEDDSYWDPNDEESMNSP CWQVKWQLRQLVRKMILRTSEETISTVQEKQQNISPLVR ERGPQRVAAHITGTRGRSNTLSSPNSKNEKALGRKINSW ESSRSGHSFLSNLHLRNGELVIHEKGFYYIYSQTYFRFQE EIKENTKNDKQMVQYIYKYTSYPDPILLMKSARNSCWS KDAEYGLYSIYQGGIFELKENDRIFVSVTNEHLIDMDHE ASFFGAFLVG |
| 187 | Mouse TRAIL | MPSSGALKDLSFSQHFRMMVICIVLLQVLLQAVSVAVTY MYFTNEMKQLQDNYSKIGLACFSKTDEDFWDSTDGEIL NRPCLQVKRQLYQLIEEVTLRTFQDTISTVPEKQLSTPPL PRGGRPQKVAAHITGITRRSNSAL1PISKDGKTLGQKIES WESSRKGHSFLNHVLFRNGELVIEQEGLYYIYSQTYFRF QEAEDASKMVSKDKVRTKQLVQYIYKYTSYPDPIVLMK SARNSCWSRDAEYGLYSIYQGGLFELKKNDRIFVSVTNE HLMDLDQEASFFGAFLIN |
| 188 | Human TWEAK | MAARRSQRRRGRRGEPGTALLVPLALGLGLALACLGLL LAVVSLGSRASLSAQEPAQEELVAEEDQDPSELNPQTEE SQDDPAPFLNRLVRPRRSAPKGRKTRARRAIAAHYEVHPR PGQDGAQAGVDGTVSGWEEARINTSSSPLRYNRQIGEFIV |

TABLE 11-continued

Example sequences

| SEQ ID NO. | NAME | SEQUENCE |
|---|---|---|
| | | TRAGLYYLYCQVHFDEGKAVYLKLDLLVDGVLALRCL EEFSATAASSLGPQLRLCQVSGLLALRPGSSLRIRTLPWA HLKAAPFLTYFGLFQVH |
| 189 | Mouse TWEAK | MASAWPRSLPQILVLGFGLVLMRAAAGEQAPGTSPCSS GSSWSADLDKCMDCASCPARPHSDFCLGCAAAPPAHFR LLWPILGGALSLVLVALVSSFLVWRRCRRREKFTTPIEE TGGEGCPGVALIQ |
| 190 | Human TRANCE | MRRASRDYTKYLRGSEEMGGGPGAPHEGPLHAPPPPAP HQPPAASRSMFVALLGLGLGQVVCSVALFFYFRAQMDP NRISEDGTHCIYRILRLHENADFQDTTLESQDTKLIPDSCR RIKQAFQGAVQKELQHIVGSQHIRAEKAMVDGSWLDLA KRSKLEAQPFAHLTINATDIPSGSHKVSLSSWYHDRGWA KISNMTFSNGKLIVNQDGFYYLYANICFRHHETSGDLAT EYLQLMVYVTKTSIKIPSSHTLMKGGSTKYWSGNSEFHF YSINVGGFFKLRSGEEISIEVSNPSLLDPDQDATYFGAFK VRDID |
| 191 | Mouse TRANCE | MRRASRDYGKYLRSSEEMGSGPGVPHEGPLHPAPSAPA PAPPPAASRSMFLALLGLGLGQVVCSIALFLYFRAQMDP NRISEDSTHCFYRILRLHENADLQDSTLESEDTLPDSCRR MKQAFQGAVQKELQHIVGPQRFSGAPAMMEGSWLDVA QRGKPEAQPFAHLTINAASIPSGSHKVTLSSWYHDRGWA KISNMTLSNGKLRVNQDGFYYLYANICFRHHETSGSVPT DYLQLMVYVVKTSIKIPSSHNLMKGGSTKNWSGNSEFH FYSINVGGFFKLRAGEEISIQVSNPSLLDPDQDATYFGAF KVQDID |
| 192 | Human TGF-beta1 | MPPSGLRLLLLLLPLLWLLVLTPGRPAAGLSTCKTIDME LVKRKRIEAIRGQILSKLRLASPPSQGEVPPGPLPEAVLAL YNSTRDRVAGESAEPEPEPEADYYAKEVTRVLMVETHN EIYDKFKQSTHSIYMFFNTSELREAVPEPVLLSRAELRLL RLKLKVEQHVELYQKYSNNSWRYLSNRLLAPSDSPEWL SFDVTGVVRQWLSRGGEIEGFRLSAHCSCDSRDNTLQV DINGFTTGRRGDLATIHGMNRPFLLLMATPLERAQHLQS SRHRRALDTNYCFSSTEKNCCVRQLYIDFRKDLGWKWI HEPKGYHANFCLGPCPYIWSLDTQYSKVLALYNQHNPG ASAAPCCVPQALEPLPIVYYVGRKPKVEQLSNMIVRSCK CS |
| 193 | Mouse TGF-beta1 | MPPSGLRLLPLLLPLPWLLVLTPGRPAAGLSTCKTIDMEL VKRKRIEAIRGQILSKLRLASPPSQGEVPPGPLPEAVLAL YNSTRDRVAGESADPEPEPEADYYAKEVTRVLMVDRNN AIYEKTKDISHSIYMFFNTSDIREAVPEPPLLSRAELRLQR LKSSVEQHVELYQKYSNNSWRYLGNRLLTPTDTPEWLS FDVTGVVRQWLNQGDGIQGFRFSAHCSCDSKDNKLHVE INGISPKRRGDLGTIHDMNRPFLLLMATPLERAQHLHSSR HRRALDTNYCFSSTEKNCCVRQLYIDFRKDLGWKWIHE PKGYHANFCLGPCPYIWSLDTQYSKVLALYNQHNPGAS ASPCCVPQALEPLPIVYYVGRKPKVEQLSNMIVRSCKCS |
| 194 | Human TGF-beta2 | MHYCVLSAFLILHLVTVALSLSTCSTLDMDQFMRKRIEA IRGQILSKLKLTSPPEDYPEPEEVPPEVISIYNSTRDLLQEK ASRRAAACERERSDEEYYAKEVYKIDMPPFFPSENAIPPT FYRPYFRIVRFDVSAMEKNASNLVKAEFRVFRLQNPKAR VPEQRIELYQILKSKDLTSPTQRYIDSKVVKTRAEGEWLS FDVTDAVHEWLHHKDRNLGFKISLHCPCCTFVPSNNYII PNKSEELEARFAGIDGTSTYTSGDQKTIKSTRKKNSGKTP HLLLMLLPSYRLESQQTNRRKKRALDAAYCFRNVQDNC CLRPLYIDFKRDLGWKWIHEPKGYNANFCAGACPYLWS SDTQHSRVLSLYNTINPEASASPCCVSQDLEPLTILYYIGK TPKIEQLSNMIVKSCKCS |
| 195 | Mouse TGF-beta2 | MHYCVLSTFLLLHLVPVALSLSTCSTLDMDQFMRKRIEA IRGQILSKLKLTSPPEDYPEPDEVPPEVISIYNSTRDLLQEK ASRRAAACERERSDEEYYAKEVYKIDMPSHLPSENAIPP TFYRPYFRIVRFDVSTMEKNASNLVKAEFRVFRLQNPKA RVAEQRIELYQILKSKDLTSPTQRYIDSKVVKTRAEGEW LSFDVTDAVQEWLHHKDRNLGFKISLHCPCCTFVPSNNY IIPNKSEELEARFAGIDGTSTYASGDQKTIKSTRKKTSGKT PHLLLMLLPSYRLESQQSSRRKKRALDAAYCFRNVQDN CCLRPLYIDFKRDLGWKWIHEPKGYNANFCAGACPYLW SSDTQHTKVLSLYNTINPEASASPCCVSQDLEPLTILYYIG NTPKIEQLSNMIVKSCKCS |

TABLE 11-continued

Example sequences

| SEQ ID NO. | NAME | SEQUENCE |
|---|---|---|
| 196 | Human TGF-beta3 | MKMHLQRALVVLALLNFATVSLSLSTCTTLDFGHIKKK RVEAIRGQILSKLRLTSPPEPTVMTHVPYQVLALYNSTRE LLEEMHGEREEGCTQENTESEYYAKEIHKFDMIQGLAEH NELAVCPKGITSKVFRFNVSSVEKNRTNLFRAEFRVLRV PNPSSKRNEQRIELFQILRPDEHIAKQRYIGGKNLPTRGT AEWLSFDVTDTVREWLLRRESNLGLEISIHCPCHTFQPN GDILENIHEVMEIKFKGVDNEDDHGRGDLGRLKKQKDH HNPHLILMMIPPHRLDNPGQGGQRKKRALDTNYCFRNL EENCCVRPLYIDFRQDLGWKWVHEPKGYYANFCSGPCP YLRSADTTHSTVLGLYNTLNPEASASPCCVPQDLEPLTIL YYVGRTPKVEQLSNMVVKSCKCS |
| 197 | Mouse TGF-beta3 | MHLQRALVVLALLNLATISLSLSTCTTLDFGHIKKKRVE AIRGQILSKLRLTSPPEPSVMTHVPYQVLALYNSTRELLE EMHGEREEGCTQETSESEYYAKEIHKFDMIQGLAEHNEL AVCPKGITSKVFRFNVSSVEKNGTNLFRAEFRVLRVPNP SSKRTEQRIELFQILRPDEHIAKQRYIGGKNLPTRGTAEW LSFDVTDTVREWLLRRESNLGLEISIHCPCHTFQPNGDIL ENVHEVMEIKFKGVDNEDDHGRGDLGRLKKQKDHHNP HLILMMIPPHRLDSPGQGSQRKKRALDTNYCFRNLEENC CVRPLYIDFRQDLGWKWVHEPKGYYANFCSGPCPYLRS ADTTHSTVLGLYNTLNPEASASPCCVPQDLEPLTILYYV GRTPKVEQLSNMVVKSCKCS |
| 198 | Human EPO | MGVHECPAWLWLLLSLLSLPLGLPVLGAPPRLICDSRVL ERYLLEAKEAENITTGCAEHCSLNENITVPDTKVNFYAW KRMEVGQQAVEVWQGLALLSEAVLRGQALLVNSSQPW EPLQLHVDKAVSGLRSLTTLLRALGAQKEAISPPDAASA APLRTITADTFRKLFRVYSNFLRGKLKLYTGEACRTGDR |
| 199 | Mouse EPO | MGVPERPTLLLLLSLLLIPLGLPVLCAPPRLICDSRVLERY ILEAKEAENVTMGCAEGPRLSENITVPDTKVNFYAWKR MEVEEQAIEVWQGLSLLSEAILQAQALLANSSQPPETLQ LHIDKAISGLRSLTSLLRVLGAQKELMSPPDTTPPAPLRT LTVDTFCKLFRVYANFLRGKLKLYTGEVCRRGDR |
| 200 | Human TPO | MELTELLLVVMLLLTARLTLSSPAPPACDLRVLSKLLRD SHVLHSRLSQCPEVHPLPTPVLLPAVDFSLGEWKTQMEE TKAQDILGAVTLLLEGVMAARGQLGPTCLSSLLGQLSG QVRLLLGALQSLLGTQLPPQGRTTAHKDPNAIFLSFQHL LRGKVRFLMLVGGSTLCVRRAPPTTAVPSRTSLVLTLNE LPNRTSGLLETNFTASARTTGSGLLKWQQGFRAKIPGLL NQTSRSLDQIPGYLNRIHELLNGTRGLFPGPSRRTLGAPD ISSGTSDTGSLPPNLQPGYSPSPTHPPTGQYTLFPLPPTLPT PVVQLHPLLPDPSAPTPTPTSPLLNTSYTHSQNLSQEG |
| 201 | Mouse TPO | MELTDLLLAAMLLAVARLTLSSPVAPACDPRLLNKLLR DSHLLHSRLSQCPDVDPLSIPVLLPAVDFSLGEWKTQTE QSKAQDILGAVSLLLEGVMAARGQLEPSCLSSLLGQLSG QVRLLLGALQGLLGTQLPLQGRTTAHKDPNALFLSLQQ LLRGKVRFLLLVEGPTLCVRRTPTTAVPSSTSQLLTLNK FPNRTSGLLETNFSVTARTAGPGLLSRLQGFRVKITPGQL NQTSRSPVQISGYLNRTHGPVNGTHGLFAGTSLQTLEAS DISPGAFNKGSLAFNLQGGLPPSPSLAPDGHTPFPPSPALP TTHGSPPQLHPLFPDPSTTMPNSTAPHPVTMYPHPRNLSQ ET |
| 202 | Human FLT-3L | MTVLAPAWSPTTYLLLLLLLSSGLSGTQDCSFQHSPISSD FAVKIRELSDYLLQDYPVTVASNLQDEELCGGLWRLVL AQRWMERLKTVAGSKMQGLLERVNTEIHFVTKCAFQPP PSCLRFVQTNISRLLQETSEQLVALKPWITRQNFSRCLEL QCQPDSSTLPPPWSPRPLEATAPTAPQPPLLLLLLLPVGL LLLAAAWCLHWQRTRRRTPRPGEQVPPVPSPQDLLLVE H |
| 203 | Mouse FLT-3L | MTVLAPAWSPNSSLLLLLLLLSPCLRGTPDCYFSHSPISS NFKVKFRELTDHLLKDYPVTVAVNLQDEKHCKALWSLF LAQRWIEQLKTVAGSKMQTLLEDVNTEIHFVTSCTFQPL PECLRFVQTNISHLLKDTCTQLLALKPCIGKACQNFSRCL EVQCQPDSSTLLPPRSPIALEATELPEPRPRQLLLLLLLLL PLTLVLLAAAWGLRWQRARRRGELHPGVPLPSHP |
| 204 | Human SCF | MKKTQTWILTCIYLQLLLFNPLVKTEGICRNRVTNNVKD VTKLVANLPKDYMITLKYVPGMDVLPSHCWISEMVVQL |

TABLE 11-continued

Example sequences

| SEQ ID NO. | NAME | SEQUENCE |
|---|---|---|
| | | SDSLTDLLDKFSNISEGLSNYSIIDKLVNIVDDLVECVKE NSSKDLKKSFKSPEPRLFTPEEFFRIFNRSIDAFKDFVVAS ETSDCVVSSTLSPEKDSRVSVTKPFMLPPVAASSLRNDSS SSNRKAKNPPGDSSLHWAAMALPALFSLIIGFAFGALYW KKRQPSLTRAVENIQINEEDNEISMLQEKEREFQEV |
| 205 | Mouse SCF | MKKTQTWIITCIYLQLLLFNPLVKTKEICGNPVTDNVKDI TKLVANLPNDYMITLNYVAGMDVLPSHCWLRDMVIQL SLSLTTLLDKFSNISEGLSNYSIIDKLGKIVDDLVLCMEEN APKNIKESPKRPETRSFTPEEFFSIFNRSIDAFKDFMVASD TSDCVLSSTLGPEKDSRVSVTKPFMLPPVAASSLRNDSSS SNRKAAKAPEDSGLQWTAMALPALISLVIGFAFGALYW KKKQSSLTRAVENIQINEEDNEISMLQQKEREFQEV |
| 206 | Human M-CSF | MTAPGAAGRCPPTTWLGSLLLLVCLLASRSITEEVSEYC SHMIGSGHLQSLQRLIDSQMETSCQITFEFVDQEQLKDPV CYLLKKAFLLVQDIMEDTMRFRDNTPNAIAIVQLQELSLR LKSCFTKDYEEHDKACVRTFYETPLQLLEKVKNVFNET KNLLDKDWNIFSKNCNNSFAECSSQDVVTKPDCNCLYP KAIPSSDPASVSPHQPLAPSMAPVAGLTWEDSEGTEGSSL LPGEQPLHTVDPGSAKQRPPRSTCQSFEPPETPVVKDSTI GGSPQPRPSVGAFNPGMEDILDSAMGTNWVPEEASGEA SEIPVPQGTELSPSRPGGGSMQTEPARPSNFLSASSPLPAS AKGQQPADVTGTALPRVGPVRPTGQDWNHTPQKTDHP SALLRDPPEPGSPRISSLRPQGLSNPSTLSAQPQLSRSHSS GSVLPLGELEGRRSTRDRRSPAEPEGGPASEGAARPLPRF NSVPLTDTGHERQSEGSFSPQLQESVFHLLVPSVILVLLA VGGLLFYRWRRRSHQEPQRADSPLEQPEGSPLTQDDRQ VELPV |
| 207 | Mouse M-CSF | MTARGAAGRCPSSTWLGSRLLLVCLLMSRSIAKEVSEHC SHMIGNGHLKVLQQLIDSQMETSCQIAFEFVDQEQLDDP VCYLKKAFFLVQDIIDETMRFKDNTPNANATERLQELSN NLNSCFTKDYEEQNKACVRTFHETPLQLLEKIKNFFNET KNLLEKDWNIFTKNCNNSFAKCSSRDVVTKPDCNCLYP KATPSSDPASASPHQPPAPSMAPLAGLAWDDSQRTEGSS LLPSELPLRIEDPGSAKQRPPRSTCQTLESTEQPNHGDRL TEDSQPHPSAGGPVPGVEDILESSLGTNWVLEEASGEAS EGFLTQEAKFSPSTPVGGSIQAETDRPRALSASPFPKSTED QKPVDITDRPLTEVNPMRPIGQTQNNTPEKTDGTSTLRE DHQEPGSPHIATPNPQRVSNSATPVAQLLLPKSHSWGIVL PLGELEGKRSTRDRRSPAELEGGSASEGAARPVARFNSIP LTDTGHVEQHEGSSDPQIPESVFHLLVPGIILVLLTVGGL LFYKWKWRSHRDPQTLDSSVGRPEDSSLTQDEDRQVEL PV |
| 208 | Human MSP | MGWLPLLLLLTQCLGVPGQRSPLNDFQVLRGTELQHLL HAVVPGPWQEDVADAEECAGRCGPLMDCRAFHYNVSS HGCQLLPWTQHSPHTRLRRSGRCDLFQKKDYVRTCIIVIN NGVGYRGTMATTVGGLPCQAWSHKFPNDHKYTPTLRN GLEENFCRNPDGDPGGPWCYTTDPAVRFQSCGIKSCREA ACVWCNGEEYRGAVDRTESGRECQRWDLQHPHQHPFE PGKFLDQGLDDNYCRNPDGSERPWCYTTDPQIEREFCDL PRCGSEAQPRQEATTVSCFRGKGEGYRGTANTTTAGVP CQRWDAQIPHQHRFTPEKYACKDLRENFCRNPDGSEAP WCFTLRPGMRAAFCYQIRRCTDDVRPQDCYHGAGEQY RGTVSKTRKGVQCQRWSAETPHKPQFTFTSEPHAQLEE NFCRNPDGDSHGPWCYTMDPRTPFDYCALRRCADDQPP SILDPPDQVQFEKCGKRVDRLDQRRSKLRVVGGHPGNSP WTVSLRNRQGQHFCGGSLVKEQWILTARQCFSSCHMPL TGYEVWLGTLFQNPQHGEPSLQRVPVAKMVCGPSGSQL VLLKLERSVTLNQRVALICLPPEWYVVPPGTKCEIAGWG ETKGTGNDTVLNVALLNVISNQECNIKHRGRVRESEMC TEGLLAPVGACEGDYGGPLACFTHNCWVLEGIIIPNRVC ARSRWPAVFTRVSVFVDWIHKVMRLG |
| 209 | Mouse MSP | MGLPLPLLQSSLLLMLLLRLSAASTNLNWQCPRIPYAAS RDFSVKYVVPSFSAGGRVQATAAYEDSTNSAVFVATRN HLHVLGPDLQFIENLTTGPIGNPGCQTCASCGPGPHGPPK DTDTLVLVMEPGLPALVSCGSTLQGRCFLHELEPRGKAL HLAAPACLFSANNNKPEACTDCVASPLGTRVTVVEQGH ASYFYVASSLDPELAASFSPRSVSIRRLKSDTSGFQPGFPS LSVLPKYLASYLIKYVYSFHSGDFVYFLTVQPISVTSPPS ALHTRLVRLNAVEPEIGDYRELVLDCHFAPKRRRRGAPE GTQPYPVLQAAHSAPVDAKLAVELSISEGQEVLFGVFVT |

TABLE 11-continued

Example sequences

| SEQ ID NO. | NAME | SEQUENCE |
|---|---|---|
| | | VKDGGSGMGPNSVVCAFPIYHLNILIEEGVEYCCHSSNSS SLLSRGLDFFQTPSFCPNPPGGEASGPSSRCHYFPLMVHA SFTRVDLFNGLLGSVKVTALHVTRLGNVTVAHMGTVD GRVLQVEIARSLNYLLYVSNFSLGSSGQPVHRDVSRLGN DLLFASGDQVFKVPIQGPGCRHFLTCWRCLRAQRFMGC GWCGDRCDRQKECPGSWQQDHCPPEISEFYPHSGPLRG TTRLTLCGSNFYLRPDDVVPEGTHQITVGQSPCRLLPKDS SSPRPGSLKEFIQELECELPLVTQAVGTTNISLVITNMPA GKHFRVEGISVQEGFSFVEPVLTSIKPDFGPRAGGTYLTL EGQSLSVGTSRAVLVNGTQCRLEQVNEEQILCVTPPGAG TARVPLHLQIGGAEVPGSWTFHYKEDPIVLDISPKCGYS GSHIMIHGQHLTSAWHFTLSFHDGQSTVESRCAGQFVEQ QQRRCRLPEYVVRNPQGWATGNLSVWGDGAAGFTLPG FRFLPPPSPLRAGLVELKPEEHSVKVEYVGLGAVADCVT VNMTVGGEVCQHELRGDVVICPLPPSLQLGKDGVPLQV CVDGGCHILSQVVRSSPGRASQRILLIALLVLILLVAVLA VALIFNSRRRKKQLGAHSLSPTTLSDINDTASGAPNHEES SESRDGTSVPLLRTESIRLQDLDRMLLAEVKDVLIPHEQV VIHTDQVIGKGHFGVVYHGEYTDGAQNQTHCAIKSLSRI TEVQEVEAFLREGLLMRGLHHPNILALIGIMLPPEGLPRV LLPYMRHGDLLHFIRSPQRNPTVKDLVSFGLQVACGME YLAEQKFVHRDLAARNCMLDESFTVKVADFGLARGVL DKEYYSVRQHRHARLPVKWMALESLQTYRFTTKSDVW SFGVLLWELLTRGAPPYPH1DPFDLSHFLAQGRRLPQPEY CPDSLYHVMLRCWEADPAARPTFRALVLEVKQVVASLL GDHYVQLTAAYVNVGPRAVDDGSVPPEQVQPSPQHCRS TSKPRPLSEPPLPT |
| 210 | Linker | GSSGGSGGSGG |
| 211 | Linker | GGGSGGGS |
| 212 | Linker | GGGSGGGSGGGS |
| 213 | Linker | GGGGSGGGGSGGGGS |
| 214 | Linker | GGGGSGGGGSGGGGSGGGGSGGGGS |
| 215 | Linker | GGGGSGGGGS |
| 216 | Linker | (GGGGS)n |
| 217 | Linker | GGGGSGS |
| 218 | Linker | GGGGSGGGGSGGGGSGS |
| 219 | Linker | GGSLDPKGGGGS |
| 220 | Linker | PKSCDKTHTCPPCPAPELLG |
| 221 | Linker | SKYGPPCPPCPAPEFLG |
| 222 | Linker | GKSSGSGSESKS |
| 223 | Linker | GSTSGSGKSSEGKG |
| 224 | Linker | GSTSGSGKSSEGSGSTKG |
| 225 | Linker | GSTSGSGKPGSGEGSTKG |
| 226 | Linker | GSTSGSGKPGSSEGST |
| 227 | Linker | (GSGGS)n |
| 228 | Linker | (GGGS)n |
| 229 | Linker | GGSG |
| 230 | Linker | GGSGG |
| 231 | Linker | GSGSG |
| 232 | Linker | GSGGG |
| 233 | Linker | GGGSG |

TABLE 11-continued

Example sequences

| SEQ ID NO. | NAME | SEQUENCE |
|---|---|---|
| 234 | Linker | GSSSG |
| 245 | Linker | GPQGTAGQ |
| 250 | Linker | YGAGLGW |
| 264 | CM | AQNLLGMY |
| 265 | CM | LSGRSDNHGGAVGLLAPP |
| 266 | CM | VHMPLGFLGPGGLSGRSDNH |
| 267 | CM | LSGRSDNHGGVHMPLGFLGP |
| 268 | CM | LSGRSDNHGGSGGSISSGLLSS |
| 269 | CM | ISSGLLSSGGSGGSLSGRSGNH |
| 270 | CM | LSGRSDNHGGSGGSQNQALRMA |
| 271 | CM | QNQALRMAGGSGGSLSGRSDNH |
| 272 | CM | LSGRSGNHGGSGGSQNQALRMA |
| 273 | CM | QNQALRMAGGSGGSLSGRSGNH |
| 274 | CM | ISSGLLSGRSGNH |
| 275 | CM | AVGLLAPPGGTSTSGRSANPRG |
| 276 | CM | TSTSGRSANPRGGGAVGLLAPP |
| 277 | CM | VHMPLGFLGPGGTSTSGRSANPRG |
| 278 | CM | TSTSGRSANPRGGGVHMPLGFLGP |
| 279 | CM | LSGRSGNHGGSGGSISSGLLSS |
| 280 | Cleavable Sequence | PRFKIIGG |
| 281 | Cleavable Sequence | PRFRIIGG |
| 282 | Cleavable Sequence | SSRHRRALD |
| 283 | Cleavable Sequence | RKSSIIIRMRDVVL |
| 284 | Cleavable Sequence | SSSFDKGKYKKGDDA |
| 285 | Cleavable Sequence | SSSFDKGKYKRGDDA |
| 286 | Cleavable Sequence | IEGR |
| 287 | Cleavable Sequence | IDGR |
| 288 | Cleavable Sequence | GGSIDGR |
| 289 | Cleavable Sequence | PLGLWA |
| 290 | Cleavable Sequence | GPQGIAGQ |
| 291 | Cleavable Sequence | GPQGLLGA |
| 292 | Cleavable Sequence | GIAGQ |
| 293 | Cleavable Sequence | GPLGIAGI |
| 294 | Cleavable Sequence | GPEGLRVG |
| 295 | Cleavable Sequence | YGAGLGVV |
| 296 | Cleavable Sequence | AGLGVVER |
| 297 | Cleavable Sequence | AGLGISST |

TABLE 11-continued

Example sequences

| SEQ ID NO. | NAME | SEQUENCE |
|---|---|---|
| 298 | Cleavable Sequence | EPQALAMS |
| 299 | Cleavable Sequence | QALAMSAI |
| 300 | Cleavable Sequence | AAYHLVSQ |
| 301 | Cleavable Sequence | MDAFLESS |
| 302 | Cleavable Sequence | ESLPVVAV |
| 303 | Cleavable Sequence | SAPAVESE |
| 304 | Cleavable Sequence | DVAQFVLT |
| 305 | Cleavable Sequence | VAQFVLT |
| 306 | Cleavable Sequence | VAQFVLTE |
| 307 | Cleavable Sequence | AQFVLTEG |
| 308 | Cleavable Sequence | PVQPIGPQ |
| 309 | IFN-α2b-1204dL-hIgG4, with signal sequence | *METDTLLLWVLLLWVPGSTG*CDLPQTHSLGSRRTLMLLA QMRRISLFSCLKDRHDFGFPQEEFGNQFQKAETIPVLHE MIQQIFNLFSTKDSSAAWDETLLLDKFYTELYQQLNDLEA CVIQGVGVTETPLMKEDSILAVRKYFQRITLYLKEKKYS PCAWEVVRAEIMRSFSLSTNLQESLRSKESGRSDNIGGGS ESKYGPPCPPCPAPEFLGGPSVFLFPPKPKDTLMISRTPEV TCVVVDVSQEDPEVQFNWYVDGVEVHNAKTKPREEQF NSTYRVVSVLTVLHQDWLNGKEYKCKVSNKGLPSSIEK TISKAKGQPREPQVYTLPPSQEEMTKNQVSLTCLVKGFY PSDIAVEWESNGQPENNYKTTPPVLDSDGSFFLYSRLTV DKSRWQQGNVFSCSVMHEALHNHYTQKSLSLS |
| 310 | IFN-α-1204dL-hIgG4 (polynucleotide) | ATGGAAACCGACACACTGCTGCTGTGGGTGCTGCTTT TGTGGGTGCCAGGATCCACAGGCTGTGATCTGCCTCA AACGCATTCATTGGGGTCCAGGCGCACGCTTATGTTG CTTGCACAGATGAGGAGAATATCACTTTTCTCTTGCTT GAAGGACCGCCACGATTTTGGCTTTCCGCAGGAAGAG TTCGGTAACCAGTTCCAAAAGGCAGAGACAATCCCCG TTTTGCATGAGATGATCCAACAGATCTTTAACCTGTTT TCAACCAAGGATAGCAGCGCAGCGTGGGATGAGACA CTGCTTGACAAGTTTTACACCGAGCTCTATCAGCAACT TAATGATCTCGAAGCCTGCGTAATTCAAGGAGTAGGC GTTACAGAGACACCTTTGATGAAGGAGGATTCCATCC TTGCAGTAAGAAAATACTTCCAGAGGATCACCCTCTA CCTCAAAGAAAAGAAATACTCCCCATGCGCGTGGGAA GTAGTGCGAGCTGAAATAATGCGGAGCTTTTCTTTGTC AACTAATCTCCAAGAATCTCTGAGAAGCAAGGAGTCA GGTAGGTCTGATAATATCGGGGGAGGTTCTGAATCTA AGTACGGCCCTCCTTGTCCTCCATGTCCTGCTCCAGAG TTTCTCGGAGGCCCCTCCGTGTTCCTGTTTCCTCCAAA GCCTAAGGACACCCTGATGATCAGCAGAACCCCTGAA GTGACCTGCGTGGTGGTCGACGTTTCACAAGAGGACC CCGAGGTGCAGTTCAATTGGTACGTGGACGGCGTGGA AGTGCACAACGCCAAGACCAAGCCTAGAGAGGAACA GTTCAACAGCACCTACAGAGTGGTGTCCGTGCTGACC GTGCTGCACCAGGATTGGCTGAACGGCAAAGAGTACA AGTGCAAGGTGTCCAACAAGGGCCTGCCTAGCAGCAT CGAGAAAACCATCAGCAAGGCCAAGGGCCAGCCAAG GGAACCCCAGGTTTACACACTGCCACCTAGCCAAGAG GAAATGACCAAGAACCAGGTGTCCCTGACCTGCCTGG TCAAGGGCTTTTACCCCTCCGATATCGCCGTGGAATG GGAGAGCAATGGCCAGCCTGAGAACAACTACAAGAC CACACCTCCTGTGCTGGACAGCGACGGCTCATTCTTCC TGTACAGCAGACTGACCGTGGACAAGAGCAGATGGC AGCAGGGCAACGTGTTCAGCTGCAGCGTGATGCACGA GGCCCTGCACAACCACTACACCCAGAAGTCTCTGAGC CTGAGCTGA |
| 311 | IFN-α2b-1490DNI-hIgG4, with signal sequence | *METDTLLLWVLLLWVPGSTG*CDLPQTHSLGSRRTLMLLA QMRRISLFSCLKDRHDFGFPQEEFGNQFQKAETIPVLHE MIQQIFNLFSTKDSSAAWDETLLLDKFYTELYQQLNDLEA CVIQGVGVTETPLMKEDSILAVRKYFQRITLYLKEKKYS PCAWEVVRADIVIRSFSLSTNLQESLRSKEISSGLLSGRSD |

TABLE 11-continued

Example sequences

| SEQ ID NO. | NAME | SEQUENCE |
|---|---|---|
| | | NIGGGSESKYGPPCPPCPAPEFLGGPSVFLFPPKPKDTLMI SRTPEVTCVVVDVSQEDPEVQFNWYVDGVEVHNAKTK PREEQFNSTYRVVSVLTVLHQDWLNGKEYKCKVSNKGL PSSIEKTISKAKGQPREPQVYTLPPSQEEMTKNQVSLTCL VKGFYPSDIAVEWESNGQPENNYKTTPPVLDSDGSFFLY SRLTVDKSRWQQGNVFSCSVMHEALHNHYTQKSLSLS |
| 312 | IFN-α2b-1490DNI- hIgG4 (polynucleotide) | ATGGAAACCGACACACTGCTGCTGTGGGTGCTGCTTT TGTGGGTGCCAGGATCCACAGGCTGTGATCTGCCTCA AACGCATTCATTGGGGTCCAGGCGCACGCTTATGTTG CTTGCACAGATGAGGAGAATATCACTTTTCTCTTGCTT GAAGGACCGCCACGATTTTGGCTTTCCGCAGGAAGAG TTCGGTAACCAGTTCCAAAAGGCAGAGACAATCCCCG TTTTGCATGAGATGATCCAACAGATCTTTAACCTGTTT TCAACCAAGGATAGCAGCGCAGCGTGGGATGAGACA CTGCTTGACAAGTTTTACACCGAGCTCTATCAGCAACT TAATGATCTCGAAGCCTGCGTAATTCAAGGAGTAGGC GTTACAGAGACACCTTTGATGAAGGAGGATTCCATCC TTGCAGTAAGAAAATACTTCCAGAGGATCACCCTCTA CCTCAAAGAAAAGAAATACTCCCCATGCGCGTGGGAA GTAGTGCGAGCTGAAATAATGCGGAGCTTTTCTTTGTC AACTAATCTCCAAGAATCTCTGAGAAGCAAGGAGATT AGTTCTGGCCTGCTGTCAGGTAGGTCTGATAATATCG GGGGAGGTTCTGAATCTAAGTACGGCCCTCCTTGTCCT CCATGTCCTGCTCCAGAGTTTCTCGGAGGCCCCTCCGT GTTCCTGTTTCCTCCAAAGCCTAAGGACACCCTGATGA TCAGCAGAACCCCTGAAGTGACCTGCGTGGTGGTCGA CGTTTCACAAGAGGACCCCGAGGTGCAGTTCAATTGG TACGTGGACGGCGTGGAAGTGCACAACGCCAAGACC AAGCCTAGAGAGGAACAGTTCAACAGCACCTACAGA GTGGTGTCCGTGCTGACCGTGCTGCACCAGGATTGGC TGAACGGCAAAGAGTACAAGTGCAAGGTGTCCAACA AGGGCCTGCCTAGCAGCATCGAGAAAACCATCAGCAA GGCCAAGGGCCAGCCAAGGGAACCCCAGGTTTACAC ACTGCCACCTAGCCAAGAGGAAATGACCAAGAACCA GGTGTCCCTGACCTGCCTGGTCAAGGGCTTTTACCCCT CCGATATCGCCGTGGAATGGGAGAGCAATGGCCAGCC TGAGAACAACTACAAGACCACACCTCCTGTGCTGGAC AGCGACGGCTCATTCTTCCTGTACAGCAGACTGACCG TGGACAAGAGCAGATGGCAGCAGGGCAACGTGTTCA GCTGCAGCGTGATGCACGAGGCCCTGCACAACCACTA CACCCAGAAGTCTCTGAGCCTGAGCTGA |
| 316 | ProC440 | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRADIVIRSFSLSTNL QESLRSKESGRSDNICPPCPAPEFLGGPSVFLFPPKPKDTL MISRTPEVTCVVVDVSQEDPEVQFNWYVDGVEVHNAK TKPREEQFNSTYRVVSVLTVLHQDWLNGKEYKCKVSNK GLPSSIEKTISKAKGQPREPQVYTLPPSQEEMTKNQVSLT CLVKGFYPSDIAVEWESNGQPENNYKTTPPVLDSDGSFF LYSRLTVDKSRWQQGNVFSCSVMHEALHNHYTQKSLSL S |
| 318 | human IgG Fc with a knob mutation | CPPCPAPEFEGGPSVFLFPPKPKDTLMISRTPEVTCVVVD VSQEDPEVQFNWYVDGVEVHNAKTKPREEQFNSTYRV VSVLTVLHQDWLNGKEYKCKVSNKGLPSSIEKTISKAKG QPREPQVYTLPPCQEEMTKNQVSLWCLVKGFYPSDIAVE WESNGQPENNYKTTPPVLDSDGSFFLYSRLTVDKSRWQ EGNVFSCSVMHEALHNHYTQKSLSLSLG |
| 319 | human IgG Fc with a hole mutation | CPPCPAPEFEGGPSVFLFPPKPKDTLMISRTPEVTCVVVD VSQEDPEVQFNWYVDGVEVHNAKTKPREEQFNSTYRV VSVLTVLHQDWLNGKEYKCKVSNKGLPSSIEKTISKAKG QPREPQVCTLPPSQEEMTKNQVSLSCAVKGFYPSDIAVE WESNGQPENNYKTTPPVLDSDGSFFLVSRLTVDKSRWQ EGNVFSCSVMHEALHNRFTQKSLSLSLG |
| 320 | stub moiety | SDNI |
| 321 | ProC732 | QSGQTDVDYYREWSWTQVSGSSGGSLSGRSDNIGSGGS CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA |

TABLE 11-continued

Example sequences

| SEQ ID NO. | NAME | SEQUENCE |
|---|---|---|
| | | VRKYFQRITLYLKEKKYSPCAWEVVRAEIMRSFSLSTNL QESLRSKELSGRSDNICPPCPAPEFLGGPSVFLFPPKPKDT LMISRTPEVTCVVVDVSQEDPEVQFNWYVDGVEVHNA KTKPREEQFNSTYRVVSVLTVLHQDWLNGKEYKCKVSN KGLPSSIEKTISKAKGQPREPQVYTLPPSQEEMTKNQVSL TCLVKGFYPSDIAVEWESNGQPENNYKTTPPVLDSDGSF FLYSRLTVDKSRWQQGNVFSCSVMHEALHNHYTQKSLS LS |
| 322 | ProC733 | QSGQTDVDYYREWSWTQVSGSSGGSLSGRSDNIGSGGS CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEIMRSFSLSTNL QESLRSKEESKYGPPCPPCPAPEFLGGPSVFLFPPKPKDTL MISRTPEVTCVVVDVSQEDPEVQFNWYVDGVEVHNAK TKPREEQFNSTYRVVSVLTVLHQDWLNGKEYKCKVSNK GLPSSIEKTISKAKGQPREPQVYTLPPSQEEMTKNQVSLT CLVKGFYPSDIAVEWESNGQPENNYKTTPPVLDSDGSFF LYSRLTVDKSRWQQGNVFSCSVMHEALHNHYTQKSLSL S |
| 323 | IFNa-26 masking peptide | TDVDYYREWSWTQVS |
| 324 | Linker | GSSGGS |
| 325 | Linker | ESKY |
| 326 | ProC286 | ESKYGPPCPPCPAPEFLGGPSVFLFPPKPKDTLMISRTPEV TCVVVDVSQEDPEVQFNWYVDGVEVHNAKTKPREEQF NSTYRVVSVLTVLHQDWLNGKEYKCKVSNKGLPSSIEK TISKAKGQPREPQVYTLPPSQEEMTKNQVSLTCLVKGFY PSDIAVEWESNGQPENNYKTTPPVLDSDGSFFLYSRLTV DKSRWQQGNVFSCSVMHEALHNHYTQKSLSLSSGGGGS GRSDNIGGGSCDLPQTHSLGSRRTLMLLAQMRRISLFSC LKDRHDFGFPQEEFGNQFQKAETIPVLHEMIQQIFNLFST KDSSAAWDETLLDKFYTELYQQLNDLEACVIQGVGVTE TPLMKEDSILAVRKYFQRITLYLKEKKYSPCAWEVVRAE IMRSFSLSTNLQESLRSKE |
| 327 | Linker | SGGG |
| 328 | Truncated IFNa-2b (amino acid 1-150) | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRADIVIRS |
| 329 | IFNa-2b L130P mutant | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYPKEKKYSPCAWEVVRAEIMRSFSLSTNL QESLRSKE |
| 331 to 479 | PM sequences | (See Table 12 below for sequences) |
| 480 | ProC859 sequence | CDLPQTHSLGSRRTLMLLAQMRKISLFSCLKDRHDFGFP QEEFGNQFQKAETIPVLHEMIQQIFNLFTTKDSSAAWDE DLLDKFCTELYQQLNDLEACVMQEERVGETPLMNVDSI LAVKKYFRRITLYLTEKKYSPCAWEVVRAEIMRSLSLST NLQERLRRKELSGRSDNICPPCPAPEFLGGPSVFLFPPKPK DTLMISRTPEVTCVVVDVSQEDPEVQFNWYVDGVEVHN AKTKPREEQFNSTYRVVSVLTVLHQDWLNGKEYKCKVS NKGLPSSIEKTISKAKGQPREPQVYTLPPSQEEMTKNQVS LTCLVKGFYPSDIAVEWESNGQPENNYKTTPPVLDSDGS FFLYSRLTVDKSRWQQGNVFSCSVMHEALHNHYTQKSL SLS |
| 481 | Universal IFN-alpha A/D sequence | CDLPQTHSLGSRRTLMLLAQMRKISLFSCLKDRHDFGFP QEEFGNQFQKAETIPVLHEMIQQIFNLFTTKDSSAAWDE DLLDKFCTELYQQLNDLEACVMQEERVGETPLMNVDSI LAVKKYFRRITLYLTEKKYSPCAWEVVRAEIMRSLSLST NLQERLRRKE |

TABLE 11-continued

Example sequences

| SEQ ID NO. | NAME | SEQUENCE |
|---|---|---|
| 482 | Interferon beta, Chain A, human (1AU1) | MSYNLLGFLQRSSNFQCQKLLWQLNGRLEYCLKDRMN FDIPEEIKQLQQFQKEDAALTIYEMLQNIFAIF RQDSSSTGWNETIVENLLANVYHQINHLKTVLEEKLEKE DFTRGKLMSSLHLKRYYGRILHYLKAKEYSH CAWTIVRVEILRNFYFINRLTGYLRN |
| 483 | IFNB_CHICK Q90873.1 | MTANHQSPGMHSILLLLLLPALTTTFSCNHLRHQDANFS WKSLQLLQNTAPPPPQPCPQQDVTFPFPETL LKSKDKKQAAITTLRILQHLFNMLSSPHTPKHWIDRTRH SLLNQIQHYIHHLEQCFVNQGTRSQRRGPRN AHLSINKYFRSIHNFLQHNNYSACTWDHVRLQARDCFR HVDTLIQWMKSRAPLTASSKRLNTQ |
| 484 | IFNA3_CANLF O97945.1 | MALPCSFSVALVLLSCHSLCCLACHLPDTHSLRNWRVLT LLGQMRRLSASSCDHYTTDFAFPPKELFDGQR LQEAQALSVVHVMTQKVFHLFCTNTSSAPWNMTLLEEL CSGLSEQLDDLDACPLQEAGLAETPLMHEDST LRTYFQRISLYLQDRNHSPCAWEMVRAEIGRSFFSLTILQ ERVRRRK |
| 485 | IFN_ANAPL P51526.1 | MPGPSAPPPPAIYSALALLLLLTPPANAFSCSPLRLHDSAF AWDSLQLLRNMAPSPTQPCPQQHAPCSFP DTLLDTNDTQQAAHTALHLLQHLFDTLSSPSTPAHWLH TARHDLLNQLQHHIHHLERCFPADAARLHRRG PRNLHLSINKYFGCIQHFLQNHTYSPCAWDHVRLEAHAC FQRIHRLTRTMR |
| 486 | IFNAH_BOVIN P49878.1 | MAPAWSFLLALLLLSCNAICSLGCHLPHTSLPNRRVLT LLRQLRRVSPSSCLQDRNDFAFPQEALGGSQ LQKAQAISVLHEVTQHTFQLFSTEGSAAAWDESLLDKLR AALDQQLTDLQACLRQEEGLRGAPLLKEDAS LAVRKYFHRLTLYLREKRHNPCAWEVVRAEVMRAFSSS TNLQERFRRKD |
| 487 | IFNA1_CHICK P42165.1 | MAVPASPQHPRGYGILLLTLLLKALATTASACNHLRPQD ATFSHDSLQLLRDMAPTLPQLCPQHNASCSF NDTILDTSNTRQADKTTHDILQHLFKILSSPSTPAHWNDS QRQSLLNRIHRYTQHLEQCLDSSDTRSRTR WPRNLHLTIKKHFSCLHTFLQDNDYSACAWEHVRLQAR AWFLHIHNLTGNTRT |
| 488 | IFNA_FELCA P35849.1 | MALPSSFLVALVALGCNSVCSLGCDLPQTHGLLNRRALT LLGQMRRLPASSCQKDRNDFAFPQDVFGGDQ SHKAQALSVVHVTNQKIFHFFCTEASSSAAWNTTLLEEF CTGLDRQLTRLEACVLQEVEEGEAPLTNEDI HPEDSILRNYFQRLSLYLQEKKYSPCAWEIVRAEIMRSLY YSSTALQKRLRSEK |
| 489 | interferon-beta-1 [Sus scrofa] AAA31056.1 | MANKCILQIALLMCFSTTALSMSYDVLRYQQRSSNLAC QKLLGQLPGTPQYCLEDRMNFEVPEEIMQPPQ FQKEDAVLIIHEMLQQIFGILRRNFSSTGWNETVIKTILVE LDGQMDDLETILEEIMEEENFPRGDMTIL HLKKYYLSILQYLKSKEYRSCAWTVVQVEILRNFSFLNR LTDYLRN |
| 490 | IFNB2_BOVIN P01576.1 | MTHRCLLQMVLLLCFSTTALSRSYSLLRFQQRRSLALCQ KLLRQLPSTPQHCLEARMDFQMPEEMKQAQQ FQKEDAILVIYEMLQQIFNILTRDFSSTGWSETIIEDLLEEL YEQMNHLEPIQKEIMQKQNSTMGDTTVL HLRKYYFNLVQYLKSKEYNRCAWTVVRVQILRNFSFLT RLTGYLRE |
| 491 | A Chain A, INTERFERON-ALPHA 2B 1RH2 | CDLPQTHSLGSRRTLMLLAQMRRISLFSCLKDRHDFGFP QEEFGNQFQKAETIPVLHEMIQQIFNLFSTK DSSAAWDETLLDKFYTELYQQLNDLEACVIQGVGVTET PLMNEDSILAVRKYFQRITLYLKEKKYSPCAW EVVRAEIMRSFSLSTNLQESLRSKE |
| 492 | Linker | SGGGG |
| 493 | ProC288 | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEINIRSFSLSTNL |

TABLE 11-continued

Example sequences

| SEQ ID NO. | NAME | SEQUENCE |
|---|---|---|
| | | QESLRSKE<u>SGGGGSGRSDNI</u>CPPCPAPEFLGGPSVFLFPP KPKDTLMISRTPEVTCVVVDVSQEDPEVQFNWYVDGVE VHNAKTKPREEQFNSTYRVVSVLTVLHQDWLNGKEYKC KVSNKGLPSSIEKTISKAKGQPREPQVYTLPPSQEEMTKN QVSLTCLVKGFYPSDIAVEWESNGQPENNYKTTPPVLDS DGSFFLYSRLTVDKSRWQQGNVFSCSVMHEALHNHYTQ KSLSLS |
| 494 | ProC289 | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEINIRSFSLSTNL QESLRSKE<u>SGGGGSGRSDNI</u><u>GPP</u>CPPCPAPEFLGGPSVFL FPPKPKDTLMISRTPEVTCVVVDSQEDPEVQFNWYVD GVEVHNAKTKPREEQFNSTYRVVSVLTVLHQDWLNGK EYKCKVSNKGLPSSIEKTISKAKGQPREPQVYTLPPSQEE MTKNQVSLTCLVKGFYPSDIAVEWESNGQPENNYKTTP PVLDSDGSFFLYSRLTVDKSRWQQGNVFSCSVMHEALH NHYTQKSLSLS |
| 495 | ProC290 | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEINIRSFSLSTNL QESLRSKESGGGGSGRSDNIE<u>SKYGPP</u>CPPCPAPEFLGGP SVFLFPPKPKDTLMISRTPEVTCVVVDVSQEDPEVQFNW YVDGVEVHNAKTKPREEQFNSTYRVVSVLTVLHQDWL NGKEYKCKVSNKGLPSSIEKTISKAKGQPREPQVYTLPPS QEEMTKNQVSLTCLVKGFYPSDIAVEWESNGQPENNYK TTPPVLDSDGSFFLYSRLTVDKSRWQQGNVFSCSVMHE ALHNHYTQKSLSLS |
| 496 | ProC291 | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEINIRSFSLSTNL QESLRSKESGGGGSGRSDNIGGGSESKYGPPCPPCPAPEF LGGPSVFLFPPKPKDTLMISRTPEVTCVVVDVSQEDPEV QFNWYVDGVEVHNAKTKPREEQFNSTYRVVSVLTVLH QDWLNGKEYKCKVSNKGLPSSIEKTISKAKGQPREPQVY TLPPSQEEMTKNQVSLTCLVKGFYPSDIAVEWESNGQPE NNYKTTPPVLDSDGSFFLYSRLTVDKSRWQQGNVFSCS VMHEALHNHYTQKSLSLS |
| 497 | ProC441 | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEINIRSFSLSTNL QESLRSKESGRSDNIGPPCPPCPAPEFLGGPSVFLFPPKPK DTLMISRTPEVTCVVVDVSQEDPEVQFNWYVDGVEVHN A |
| 498 | ProC442 | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRAEINIRSFSLSTNL QESLRSKESGRSDNIESKYGPPCPPCPAPEFLGGPSVFLFP PKPKDTLMISRTPEVTCVVVDVSQEDPEVQFNWYVDGV EVHNAKTKPREEQFNSTYRVVSVLTVLHQDWLNGKEY KCKVSNKGLPSSIEKTISKAKGQPREPQVYTLPPSQEEMT KNQVSLTCLVKGFYPSDIAVEWESNGQPENNYKTTPPVL DSDGSFFLYSRLTVDKSRWQQGNVFSCSVMHEALHNHY TQKSLSLS |
| 499 | ProC443 | CDLPQTHSLGSRRTLMLLAQMRRISLFSCLKDRHDFGFP QEEFGNQFQKAETIPVLHEMIQQIFNLFSTKDSSAAWDET LLDKFYTELYQQLNDLEACVIQGVGVTETPLMKEDSILA VRKYFQRITLYLKEKKYSPCAWEVVRADIVIRSFSLSTNL QESLRSKESGRSDNIGGGSESKYGPPCPPCPAPEFLGGPS VFLFPPKPKDTLMISRTPEVTCVVVDVSQEDPEVQFNWY VDGVEVHNAKTKPREEQFNSTYRVVSVLTVLHQDWLN GKEYKCKVSNKGLPSSIEKTISKAKGQPREPQVYTLPPSQ EEMTKNQVSLTCLVKGFYPSDIAVEWESNGQPENNYKT TPPVLDSDGSFFLYSRLTVDKSRWQQGNVFSCSVMHEA LHNHYTQKSLSLS |

TABLE 11-continued

Example sequences

| SEQ ID NO. | NAME | SEQUENCE |
|---|---|---|
| 235 | ProC1023 | QSGQTDVDYYREWSWTQVSGSSGGSLSGRSDNIGSGGS<br>CDLPQTHSLGSRRTLMLLAQMRKISLFSCLKDRHDFGFP<br>QEEFGNQFQKAETIPVLHEMIQQIFNLFTTKDSSAAWDE<br>DLLDKFCTELYQQLNDLEACVMQEERVGETPLMNVDSI<br>LAVKKYFRRITLYLTEKKYSPCAWEVVRAEIMRSLSLSTN<br>LQERLRRKELSGRSDNICPPCPAPEFLGGPSVFLFPPKPKD<br>TLMISRTPEVTCVVVDVSQEDPEVQFNWYVDGVEVHNA<br>KTKPREEQFNSTYRVVSVLTVLHQDWLNGKEYKCKVSN<br>KGLPSSIEKTISKAKGQPREPQVYTLPPSQEEMTKNQVSL<br>TCLVKGFYPSDIAVEWESNGQPENNYKTTPPVLDSDGSF<br>FLYSRLTVDKSRWQQGNVFSCSVMHEALHNHYTQKSLS<br>LS |
| 236 | ProC1549 | QSGQTDVDYYREWSWTQVSGSSGGSGGGSGGGSGSGG<br>SCDLPQTHSLGSRRTLMLLAQMRKISLFSCLKDRHDFGF<br>PQEEFGNQFQKAETIPVLHEMIQQIFNLFTTKDSSAAWDE<br>DLLDKFCTELYQQLNDLEACVMQEERVGETPLMNVDSI<br>LAVKKYFRRITLYLTEKKYSPCAWEVVRAEIMRSLSLST<br>NLQERRRKEGGSGGGGSCPPCPAPEFLGGPSVFLFPPKPK<br>DTLMISRTPEVTCVVVDVSQEDPEVQFNWYVDGVEVHN<br>AKTKPREEQFNSTYRVVSVLTVLHQDWLNGKEYKCKVS<br>NKGLPSSIEKTISKAKGQPREPQVYTLPPSQEEMTKNQVS<br>LTCLVKGFYPSDIAVEWESNGQPENNYKTTPPVLDSDGS<br>FFLYSRLTVDKSRWQQGNVFSCSVMHEALHNHYTQKSL<br>SLS |
| 237 | ProC659 (non-cleavable steric masked IFN-a2b) | CDLPQTHSLGSRRTLMLLAQMRRISLFSCLKDRHDFGFP<br>QEEFGNQFQKAETIPVLHEMIQQIFNLFSTKDSSAAWDET<br>LLDKFYTELYQQLNDLEACVIQGVGVTETPLMKEDSILA<br>VRKYFQRITLYLKEKKYSPCAWEVVRADIVIRSFSLSTNL<br>QESLRSKEGGGSGGSCPPCPAPEFLGGPSVFLFPPKPKDT<br>LMISRTPEVTCVVVDVSQEDPEVQFNWYVDGVEVHNA<br>KTKPREEQFNSTYRVVSVLTVLHQDWLNGKEYKCKVSN<br>KGLPSSIEKTISKAKGQPREPQVYTLPPSQEEMTKNQVSL<br>TCLVKGFYPSDIAVEWESNGQPENNYKTTPPVLDSDGSF<br>FLYSRLTVDKSRWQQGNVFSCSVMHEALHNHYTQKSLS<br>LS |
| 238 | ProC1239 Arm 1 | QSGQTDVDYYREWSWTQVSGSSGGSLSGRSDNIGSGGS<br>CDLPQTHSLGSRRTLMLLAQMRRISLFSCLKDRHDFGFP<br>QEEFGNQFQKAETIPVLHEMIQQIFNLFSTKDSSAAWDET<br>LLDKFYTELYQQLNDLEACVIQGVGVTETPLMKEDSILA<br>VRKYFQRITLYLKEKKYSPCAWEVVRADIVIRSFSLSTNL<br>QESLRSKELSGRSDNICPPCPAPEFEGGPSVFLFPPPKPKDT<br>LMISRTPEVTCVVVDVSQEDPEVQFNWYVDGVEVHNA<br>KTKPREEQFNSTYRVVSVLTVLHQDWLNGKEYKCKVSN<br>KGLPSSIEKTISKAKGQPREPQVYTLPPCQEEMTKNQVSL<br>WCLVKGFYPSDIAVEWESNGQPENNYKTTPPVLDSDGS<br>FFLYSRLTVDKSRWQEGNVFSCSVMHEALHNHYTQKSL<br>SLSLGK |
| 239 | ProC1239 Arm 2 | SDNICPPCPAPEFEGGPSVFLFPPPKPKDTLMISRTPEVTCV<br>VVDVSQEDPEVQFNWYVDGVEVHNAKTKPREEQFNST<br>YRVVSVLTVLHQDWLNGKEYKCKVSNKGLPSSIEKTISK<br>AKGQPREPQVCTLPPSQEEMTKNQVSLSCAVKGFYPSDI<br>AVEWESNGQPENNYKTTPPVLDSDGSFFLVSRLTVDKSR<br>WQEGNVFSCSVMHEALHNRFTQKSLSLSLG |
| 240 | ProC1301 | QSGQTDVDYYREWSWTQVSGSSGGSGGGSGGGSGSGG<br>SCDLPQTHSLGSRRTLMLLAQMRRISLFSCLKDRHDFGF<br>PQEEFGNQFQKAETIPVLHEMIQQIFNLFSTKDSSAAWDE<br>TLLDKFYTELYQQLNDLEACVIQGVGVTETPLMKEDSIL<br>AVRKYFQRITLYLKEKKYSPCAWEVVRAEIMRSFSLSTN<br>LQESRSKEGGSGGGGSCPPCPAPEFLGGPSVFLFPPKPKD<br>TLMISRTPEVTCVVVDVSQEDPEVQFNWYVDGVEVHNA<br>KTKPREEQFNSTYRVVSVLTVLHQDWLNGKEYKCKVSN<br>KGLPSSIEKTISKAKGQPREPQVYTLPPSQEEMTKNQVSL<br>TCLVKGFYPSDIAVEWESNGQPENNYKTTPPVLDSDGSF<br>FLYSRLTVDKSRWQQGNVFSCSVMHEALHNHYTQKSLS<br>LS |
| 241 | CM | GLSGRSDNHG |
| 242 | Signal sequence | MRAWIFFLLCLAGRALA |

TABLE 11-continued

Example sequences

| SEQ ID NO. | NAME | SEQUENCE |
|---|---|---|
| 243 | Signal sequence | MALTFALLVALLVLSCKSSCSVG |
| 244 | Signal sequence | METDTLLLWVLLLWVPGSTG |
| 246 | spacer | QGQSGS |
| 247 | spacer | GQSGS |
| 248 | spacer | QSGS |
| 249 | spacer | QGQSGQG |
| 251 | spacer | GQSGQG |
| 252 | spacer | QSGQG |
| 253 | spacer | SGQG |
| 254 | spacer | QGQSGQ |
| 255 | spacer | GQSGQ |
| 256 | spacer | QSGQ |
| 257 | spacer | QGQSG |
| 258 | spacer | QGQS |
| 259 | ProC1640 | DNIGSGGSCDLPQTHSLGSRRTLMLLAQMRRISLFSCLK DRHDFGFPPQEEFGNQFQKAETIPVLHEMIQQIFNLFSTKD SSAAWDETLLDKFYTELYQQLNDLEACVIQGVGVTETP LMKEDSILAVRKYFQRITLYLKEKKYSPCAWEVVRAEIM RSFSLSTNLQESLRSKELSGRS |
| 260 | ProC1822 | KNLKSPQKVEVDIIDDNFILRWNRSDESVGNVTFSFDYQ KTGMDNWIKLSGCQNITSTKCNFSSLKLNVYEEIKLRIRA EKENTSSWYEVDSFTPFRKAQIGPPEVHLEAEDKAIVIHI SPGTKDSVMWALDGLSFTYSLVIWKNSSGVEERIENIYS RHKIYKLSPETTYCLKVKAALLTSWKIGVYSPVHCIKTT VENELPPPENIEVSVQNQNYVLKWDTYANMTFQVQW LHAFLKRNPGNHLYKWKQIPDCENVKTTQCVFPQNVFQ KGIYLLRVQASDGNNTSFWSEEIKFDTEIQAFLLPPVFNIR SLSDSFHIYIGAPKQSGNTPVIQDYPLIYEIIFWENTSNAE RKIIEKKTDVTVPNLKPLTVYCVKARAHTMDEKLNKSS VFSDAVCEKTKPGNTSKPKSCDKTHTCPPCPAPELLGGP SVFLFPPKPKDTLMISRTPEVTCVVVDVSHEDPEVKFNW YVDGVEVHNAKTKPREEQYNSTYRVVSVLTVLHQDWL NGKEYKCKVSNKALPAPIEKTISKAKGQPREPQVYTLPP SREEMTKNQVSLTCLVKGFYPSDIAVEWESNGQPENNY KTTPPVLDSDGSFFLYSKLTVDKSRWQQGNVFSCSVMH EALHNHYTQKSLSLSPG |
| 261 | ProC1823 | ISYDSPDYTDESCTFKISLRNFRSILSWELKNHSIVPTHYT LLYTIMSKPEDLKVVKNCANTTRSFCDLTDEWRSTHEA YVTVLEGFSGNTTLFSCSHNFWLAIDMSFEPPEFEIVGFT NHINVMVKFPSIVEEELQFDLSLVIEEQSEGIVKKHKPEIK GNMSGNFTYIIDKLIPNTNYCVSVYLEHSDEQAVIKSPLK CTLLPPGQESESAESAKPKSCDKTHTCPPCPAPELLGGPS VFLFPPKPKDTLMISRTPEVTCVVVDVSHEDPEVKFNWY VDGVEVHNAKTKPREEQYNSTYRVVSVLTVLHQDWLN GKEYKCKVSNKALPAPIEKTISKAKGQPREPQVYTLPPSR EEMTKNQVSLTCLVKGFYPSDIAVEWESNGQPENNYKT TPPVLDSDGSFFLYSKLTVDKSRWQQGNVFSCSVMHEA LHNHYTQKSLSLSPG |
| 262 | ProC1824 | KNLKSPQKVEVDVIDDNFILRWNRSEESVGNVTFSFDYQ KPEMDNWIKLPGCQNMTSTKCNFSSLKLNIYDEIKLRIR AEKENTSSWCEVDSFTPFRKAQIGPPEVHLEAEDKAIVIY ISPPGTEDSVMWALDRSSFTYSLVIWKNSSSVEERIENIYS RHKISKLSPETTYCLKVKAALLTSRKIGVYGPVHCIKTTV ENELPPPENIEVIVQNQNYVLKWDTYANMTFQVQWLH AFLKRKPGNHLYKWKQIPDCENVTTTQCVFPPNTFQKGI YLLRVQASDGNNTSFWSEEIKFDTEIQASLLPPVFNIRSLS DSLHISIGAPKWSENKPVIQDYPLIYEILFWENTSKAERKI |

TABLE 11-continued

Example sequences

| SEQ ID NO. | NAME | SEQUENCE |
|---|---|---|
| | | IKKKTDVTIPNLKPLTVYCVKARAHSMDEKLNKSSVFSD VVCEETKSGNTSKPKSCDKTHTCPPCPAPELLGGPSVFLF PPKPKDTLMISRTPEVTCVVVDVSHEDPEVKFNWYVDG VEVHNAKTKPREEQYNSTYRVVSVLTVLHQDWLNGKE YKCKVSNKALPAPIEKTISKAKGQPREPQVYTLPPSREE MTKNQVSLTCLVKGFYPSDIAVEWESNGQPENNYKTTP PVLDSDGSFFLYSKLTVDKSRWQQGNVFSCSVMHEALH NHYTQKSLSLSPG |
| 263 | ProC1825 | ISHDLPDYTSESCTFKISLRNFRSILSWELKNHSIVATHYK LLYTIMSKPEDLKIVKNCANTTRSFCDLTDEWRSTHEAY VTSLEGFSGNTTLFNCSHNFWLDIDMSFEPPEFEIVGFTN HINVIVKFPSIVEEELQFDLSLVIEEQSEGIVKKHKPTIKG NMSGNFTYIIDKLIPNTNYCVSVYFDHNDEQAVIKSPLKC TLLQPGQESESAESAKPKSCDKTHTCPPCPAPELLGGPSV FLFPPKPKDTLMISRTPEVTCVVVDVSHEDPEVKFNWYV DGVEVHNAKTKPREEQYNSTYRVVSVLTVLHQDWLNG KEYKCKVSNKALPAPIEKTISKAKGQPREPQVYTLPPSRE EMTKNQVSLTCLVKGFYPSDIAVEWESNGQPENNYKTT PPVLDSDGSFFLYSKLTVDKSRWQQGNVFSCSVMHEAL HNHYTQKSLSLSPG |
| 313 | ProC1718 | ISYDSPDYTDESCTFKISLRNFRSILSWELKNHSIVPTHYT LLYTIMSKPEDLKVVKNCANTTRSFCDLTDEWRSTHEA YVTVLEGFSGNTTLFSCSHNFWLAIDMSFEPPEFEIVGFT NHINVMVKFPSIVEEELQFDLSLVIEEQSEGIVKKHKPEIK GNMSGNFTYIIDKLIPNTNYCVSVYLEHSDEQAVIKSPLK CTLLPPGQESESAESAKGGGGSHHHHHHHH |
| 314 | ProC1976 | DNIGSGGSCDLPQTHSLGSRRTLMLLAQMRRISLFSCLK DRHDFGFPQEEFGNQFQKAETIPVLHEMIQQIFNLFSTKD SSAAWDETLLDKFYTELYQQLNDLEACVIQGVGVTETP LMKEDSILAVRKYFQRITLYLKEKKYSPCAWEVVRAEIM RSFSLSTNLQESLRSKELSGRS |

TABLE 12

Examples of Masking Peptides (PMs) Correlated with Appropriate Cytokines

| Cytokine that may be coupled with the PM | PM Sequence | SEQ ID NO. |
|---|---|---|
| IFN | IAYLEYYEHLHMAYG | 331 |
| IFN | TDVDYYREWCWTQVS | 332 |
| IFN | FPLNTFD TABLE 12-continued Examples of Masking Peptides (PMs) Correlated with Appropriate Cytokines

| Cytokine that may be coupled with the PM | PM Sequence | SEQ ID NO. |
|---|---|---|
| IFN | NLDFYLNHLYNTLAG | 345 |
| IFN | DFINSMRSHLQSSDQ | 346 |
| IFN | EPKCSFCSPLIVPSP | 347 |
| IFN | PNCIESFLSSIHDSL | 348 |
| IFN | TDNALFLETVQHYLY | 349 |
| IFN | CYPSISWLFADAPRN | 350 |
| IFN | ELTQLLNALVDVRNC | 351 |
| IFN | LLSSFVETMSSILTC | 352 |
| IFN | YLLRLPSLEELWGPS | 353 |
| IFN | ATCYIINHWVERYII | 354 |
| IFN | IAYLEYYEHLHMAY | 355 |
| IFN | RVTCDDYYYGFGCNKFGRPA | 356 |
| IFN | MLAVVGAAALVLVAGAPWVLPSAAGGENLKPP ENIDVYIIDDNYTLKWSSHGESMGSVTFSAEYRT KDEAKWLKVPECQHTTTTKCEFSLLDTNVYIKT QFRVRAEEGNSTSSWNEVDPFIPFYTAHMSPPEV RLEAEDKAILVHISPPGQDGNMWALEKPSFSYTI RIWQKSSSDKKTINSTYYVEKIPELLPETTYCLEV KAIHPSLKKHSNYSTVQCISTTVANKMPVPGNLQ VDAQGKSYVLKWDYIASADVLFRAQWLPGYSK SSSGSRSDKWKPIPTCANVQTTHCVFSQDTVYTG TFFLHVQASEGNHTSFWSEEKFIDSQKHILPPPPVI TVTAMSDTLLVYVNCQDSTCDGLNYEIIFWENTS NTKISMEKDGPEFTLKNLQPLTVYCVQARVLFR ALLNKTSNFSEKLCEKTRPGSFST | 357 |
| IFN | MLLSQNAFIFRSLNLVLMVYISLVFGISYDSPDYT DESCTFKISLRNFRSILSWELKNHSIVPTHYTLLY TIMSKPEDLKVVKNCANTTRSFCDLTDEWRSTH EAYVTVLEGFSGNTTLFSCSHNFWLAIDMSFEPP EFEIVGFTNHINVMVKFPSIVEEELQFDLSLVIEEQ SEGIVKKHKPEIKGNMSGNFTYIIDKLIPNTNYCV SVYLEHSDEQAVIKSPLKCTLLPPGQESESAESAK | 358 |
| IFN | MMVVLLGATTLVLVAVAPWVLSAAAGGKNLKS PQKVEVDIIDDNFILRWNRSDESVGNVTFSFDYQ KTGMDNWIKLSGCQNITSTKCNFSSLKLNVYEEI KLRIRAEKENTSSWYEVDSFTPFRKAQIGPPEVH LEAEDKAIVIHISPGTKDSVMWALDGLSFTYSLVI WKNSSGVEERIENIYSRHKIYKLSPETTYCLKVK AALLTSWKIGVYSPVHCIKTTVENELPPPENIEVS VQNQNYVLKWDYTYANMTFQVQWLHAFLKRN PGNHLYKWKQIPDCENVKTTQCVFPQNVFQKGI YLLRVQASDGNNTSFWSEEIKFDTEIQAFLLPPVF NIRSLSDSFHIYIGAPKQSGNTPVIQDYPLIYEIIFW ENTSNAERKIIEKKTDVTVPNLKPLTVYCVKARA HTMDEKLNKSSVFSDAVCEKTKPGNTSK | 359 |
| IFN | MRSRCTVSAVGLLSLCLVVSASLETITPSAFDGY PDEPCTINITIRNSRLILSWELENKSGPPANYTLW YTVMSKDENLTKVKNCSDTTKSSCDVTDKWLE GMESYVVAIVIVHRGDLTVCRCSDYIVPANAPLE PPEFEIVGFTDHINVTMEFPPVTSKIIQEKMKTTPF VIKEQIGDSVRKKHEPKVNNVTGNFTFVLRDLLP KTNYCVSLYFDDDPAIKSPLKCIVLQPGQESGLSE SA | 360 |
| IFN-α | TDVDYYREWXXXXXXXX (X may be any amino acid) | 361 |

TABLE 12-continued

Examples of Masking Peptides (PMs) Correlated with Appropriate Cytokines

| Cytokine that may be coupled with the PM | PM Sequence | SEQ ID NO. |
|---|---|---|
| IFN-α and IFN-β | GSGTDVDYYREWSWTQV | 362 |
| IFN-α and IFN-β | GSGTDVDYYREWSWTQVS | 363 |
| IFN-α and IFN-β | TDVDYYREWSWTQV | 364 |
| IFN-α and IFN-β | TDVDYYREWSWTQVS | 323 |
| IFN-γ | ALTSTEDPEPPSVPVPTNVLIKSYNLNPVVCWEY<br>QNMSQTPIFTVQVKVYSGSWTDSCTNISDHCCNI<br>YEQIMYPDVSAWARVKAKVGQKESDYARSKEF<br>LMCLKGKVGPPGLEIRRKKEEQLSVLVFHPEVV<br>VNGESQGTMFGDGSTCYTFDYTVYVEHNRSGET<br>LHTKHTVEKEECNETLCELNISVSTLDSRYCLSV<br>DGISSFWQVRTEKSKDVCIPPFHDDRKDS | 366 |
| IFN-γ | ASSPDSFSQLAAPLNPRLHLYNDEQILTWEPSPSS<br>NDPRPVVYQVEYSFIDGSWHRLLEPNCTDITETK<br>CDLTGGGRLKLFPHPFTVFLRVRAKRGNLTSKW<br>VGLEPFQHYENVTVGPPKNISVTPGKGSLVIHFSP<br>PFDVFHGATFQYLVHYWEKSETQQEQVEGPFKS<br>NSIVLGNLKPYRVYCLQTEAQLILKNKKIRPHGL<br>LSNVSCHETTANASARLQQVILIPLGIFALLLGLT<br>GACFTLFLKYQSRVKYWFQAPPNIPEQIEEYLKD<br>PDQFILEVLDKDGSPKEDSWDSVSIISSPEKERDD<br>VLQTP | 367 |
| IFN-γ | EMGTADLGPSSVPTPTNVTIESYNMNPIVYWEYQ<br>IMPQVPVFTVEVKNYGVKNSEWIDACINISHHYC<br>NISDHVGDPSNSLWVRVKARVGQKESAYAKSEE<br>FAVCRDGKIGPPKLDIRKEEKQIMIDIFHPSVFVN<br>GDEQEVDYDPETTCYIRVYNVYVRMNGSEIQYK<br>ILTQKEDDCDEIQCQLAIPVSSLNSQYCVSAEGVL<br>HVWGVTTEKSKEVCITIFNSSIKG | 368 |
| IFN-γ | SQLPAPQHPKIRLYNAEQVLSWEPVALSNSTRPV<br>VYQVQFKYTDSKWFTADIMSIGVNCTQITATECD<br>FTAASPSAGFPMDFNVTLRLRAELGALHSAWVT<br>MPWFQHYRNVTVGPPENIEVTPGEGSLIIRFSSPF<br>DIADTSTAFFCYYVHYWEKGGIQQVKGPFRSNSI<br>SLDNLKPSRVYCLQVQAQLLWNKSNIFRVGHLS<br>NISCYETMADASTELQQ | 369 |
| IL-12 | CRTSECCFQDPPYPDADSGSASGPRDLRCYRISSD<br>RYECSWQYEGPTAGVSHFLRCCLSSGRCCYFAA<br>GSATRLQFSDQAGVSVLYTVTLWVESWARNQTE<br>KSPEVTLQLYNSVKYEPPLGDIKVSKLAGQLRME<br>WETPDNQVGAEVQFRHRTPSSPWKLGDCGPQD<br>DDTESCLCPLEMNVAQEFQLRRRQLGSQGSSWS<br>KWSSPVCVPPENPPQPQVRFSVEQLGQDGRRRLT<br>LKEQPTQLELPEGCQGLAPGTEVTYRLQLHMLSC<br>PCKAKATRTLHLGKMPYLSGAAYNVAVISSNQF<br>GPGLNQTWHIPADTHTEPVALNISVGTNGTTMY<br>WPARAQSMTYCIEWQPVGQDGGLATCSLTAPQ<br>DPDPAGMATYSWSRESGAMGQEKCYYITIFASA<br>HPEKLTLWSTVLSTYHFGGNASAAGTPHHVSVK<br>NHSLDSVSVDWAPSLLSTCPGVLKEYVVRCRDE<br>DSKQVSEHPVQPTETQVTLSGLRAGVAYTVQVR<br>ADTAWLRGVWSQPQRFSIEVQVSDWLIFFASLGS<br>FLSILLVGVLGYLGLNRAARHLCPPLPTPCASS<br>AIEFPGGKETWQWINPVDFQEEASLQEAL<br>VVEMSWDKGERTEPLEKTELPEGAP<br>ELALDTELSLEDGDRCKAKM | 370 |
| IL-12 | KIDACKRGDVTVKPSHVILLGSTVNITCSLKPRQ<br>GCFHYSRRNKLILYKFDRRINFHHGHSLNSQVTG<br>LPLGTTLFVCKLACINSDEIQICGAEIFVGVAPEQP<br>QNLSCIQKGEQGTVACTWERGRDTHLYTEYTLQ | 371 |

TABLE 12-continued

Examples of Masking Peptides (PMs) Correlated with Appropriate Cytokines

| Cytokine that may be coupled with the PM | PM Sequence | SEQ ID NO. |
|---|---|---|
| | LSGPKNLTWQKQCKDIYCDYLDFGINLTPESPES<br>NFTAKVTAVNSLGSSSSLPSTFTFLDIVRPLPPWD<br>IRIKFQKASVSRCTLYWRDEGLVLLNRLRYRPSN<br>SRLWNMVNVTKAKGRHDLLDLKPFTEYEFQISS<br>KLHLYKGSWSDWSESLRAQTPEEEPTGMLDVW<br>YMKRHIDYSRQQISLFWKNLSVSEARGKILHYQ<br>VTLQELTGGKAMTQNITGHTSWTTVIPRTGNWA<br>VAVSAANSKGSSLPTRINEVINLCEAGLLAPRQVS<br>ANSEGMDNILVTWQPPRKDPSAVQEYVVEWREL<br>HPGGDTQVPLNWLRSRPYNVSALISENIKSYICY<br>EIRVYALSGDQGGCSSILGNSKHKAPLSGPHINAI<br>TEEKGSILISWNSIPVQEQMGCLLHYRIYWKERD<br>SNSQPQLCEIPYRVSQNSHPINSLQPRVTYVLWM<br>TALTAAGESSHGNEREFCLQGKANWMAFVAPSI<br>CIAIIMVGIFSTHYFQQKVFVLLAALRPQWCSREI<br>PDPANSTCAKKYPIAEEKTQLPLDRLLIDWPTPE<br>DPEPLVISEVLHQVTPVFRHPPCSNWPQREKGIQ<br>GHQASEKDMMHSASSPPPPRALQAESRQLVDLY<br>KVLESRGSDPKPENPACPWTVLPAGDLPTHDGY<br>LPSNIDDLPSHEAPLADSLEELEPQHISLSVFPSSS<br>LHPLTFSCGDKLTLDQLKMRCDSLML | |
| IL-12 | NIDVCKLGTVTVQPAPVIPLGSAANISCSLNPKQG<br>CSHYPSSNELILLKFVNDVLVENLHGKKVHDHT<br>GHSSTFQVTNLSLGMTLFVCKLNCSNSQKKPPVP<br>VCGVEISVGVAPEPPQNISCVQEGENGTVACSWN<br>SGKVTYLKTNYTLQLSGPNNLTCQKQCFSDNRQ<br>NCNRLDLGINLSPDLAESRFIVRVTAINDLGNSSS<br>LPHTFTFLDIVIPLPPWDIRINFLNASGSRGTLQWE<br>DEGQVVLNQLRYQPLNSTSWNMVNATNAKGKY<br>DLRDLRPFTEYEFQISSKLHLSGGSWSNWSESLR<br>TRTPEEEPVGILDIWYMKQDIDYDRQQISLFWKS<br>LNPSEARGKILHYQVTLQEVTKKTTLQNTTRHTS<br>WTRVIPRTGAWTASVSAANSKGASAPTHINIVDL<br>CGTGLLAPHQVSAKSENMDNILVTWQPPKKADS<br>AVREYIVEWRALQPGSITKFPPHWLRIPPDNMSA<br>LISENIKPYICYEIRVHALSESQGGCSSIRGDSKHK<br>APVSGPHITAITEKKERLFISWTHIPFPEQRGCILH<br>YRIYWKERDSTAQPELCEIQYRRSQNSHPISSLQP<br>RVTYVLWMTAVTAAGESPQGNEREFCPQGKAN<br>WKAFVISSICIAIITVGTFSIRYFRQKAFTLLSTLKP<br>QWYSRTIPDPANSTWVKKYPILEEKIQLPTDNLL<br>MAWPTPEEPEPLIIHEVLYHMIPVVRQPYYFKRG<br>QGFQGYSTSKQDAMYIANPQATGTLTAETRQLV<br>NLYKVLESRDPDSKLANLTSPLTVTPVNYLPSHE<br>GYLPSNIEDLSPHEADPTDSFDLEHQHISLSIFASS<br>SLRPLIFGGERLTLDRLKMGYDSLMSNEA | 372 |
| IL-12 | QLGASGPGDGCCVEKTSFPEGASGSPLGPRNLSC<br>YRVSKTDYECSWQYDGPEDNVSHVLWCCFVPP<br>NHTHTGQERCRYFSSGPDRTVQFWEQDGIPVLS<br>KVNFWVESRLGNRTMKSQKISQYLYNWTKTTPP<br>LGHIKVSQSHRQLRMDWNVSEEAGAEVQFRRR<br>MPTTNWTLGDCGPQVNSGSGVLGDIRGSMSESC<br>LCPSENMAQEIQIRRRRRLSSGAPGGPWSDWSMP<br>VCVPPEVLPQALVPRGS | 373 |
| IL-12 | QLGASGPGDGCCVEKTSFPEGASGSPLGPRNLSC<br>YRVSKTDYECSWQYDGPEDNVSHVLWCCFVPP<br>NHTHTGQERCRYFSSGPDRTVQFWEQDGIPVLS<br>KVNFWVESRLGNRTMKSQKISQYLYNWTKTTPP<br>LGHIKVSQSHRQLRMDWNVSEEAGAEVQFRRR<br>MPTTNWTLGDCGPQVNSGSGVLGDIRGSMSESC<br>LCPSENMAQEIQIRRRRRLSSGAPGGPWSDWSMP<br>VCVPPEVLPQAKIKFLVEPLNQGGRRRLTMQGQ<br>SPQLAVPEGCRGRPGAQVKKHLVLVRMLSCRCQ<br>AQTSKTVPLGKKLNLSGATYDLNVLAKTRFGRS<br>TIQKWHLPAQELTETRALNVSVGGNMTSMQWA<br>AQAPGTTYCLEWQPWFQHRNHTHCTLIVPEEED<br>PAKMVTHSWSSKPTLEQEECYRITVFASKNPKNP<br>MLWATVLSSYYFGGNASRAGTPRHVSVRNQTG<br>DSVSVEWTASQLSTCPGVLTQYVVRCEAEDGA<br>WESEWLVPPTKTQVTLDGLRSRVMYKVQVRAD | 374 |

TABLE 12-continued

Examples of Masking Peptides (PMs) Correlated with Appropriate Cytokines

| Cytokine that may be coupled with the PM | PM Sequence | SEQ ID NO. |
|---|---|---|
| | TARLPGAWSHPQRFSFEVQISRLSIIFASLGSFASV LLVGSLGYIGLNRAAWHLCPPLPTPCGSTAVEFP GSQGKQAWQWCNPEDFPEVLYPRDALVVEMPG DRGDGTESPQAAPECALDTRRPLETQRQRQVQA LSEARRLGLAREDCPRGDLAHVTLPLLLGGVTQ GASVLDDLWRTHKTAEPGPPTLGQEA | |
| IL-15 | AVNGTSQFTCFYNSRANISCVWSQDGALQDTSC QVHAWPDRRRWNQTCELLPVSQASWACNLILG APDSQKLTTVDIVTLRVLCREGVRWRVMAIQDF KPFENLRLMAPISLQVVHVETHRCNISWETSQAS HYFERHLEFEARTLSPGHTWEEAPLLTLKQKQE WICLETLTPDTQYEFQVRVKPLQGEFTTWSPWSQ PLAFRTKPAALGKDT | 375 |
| IL-15 | ITCPPPMSVEHADIWVKSYSLYSRERYICNSGFKR KAGTSSLTECVLNKATNVAHWTTPSLKCIRDPAL VHQRPAPP | 376 |
| IL-15 | ITCPPPMSVEHADIWVKSYSLYSRERYICNSGFKR KAGTSSLTECVLNKATNVAHWTTPSLKCIRDP | 377 |
| IL-15 | ITCPPPMSVEHADIWVKSYSLYSRERYICNSGFKR KAGTSSLTECVLNKATNVAHWTTPSLKCIR | 378 |
| IL-15 | ITCPPPMSVEHADIWVKSYSLYSRERYICNSGFKR KAGTSSLTECVLNKATNVAHWTTPSLKCIRDPAL VHQRPAPPSTVTTAGVTPQPESLSPSGKEPAASSP SSNNTAATTAAIVPGSQLMPSKSPSTGTTEISSHE SSHGTPSQTTAKNWELTASASHQPPGVYPQGHS DTT | 379 |
| IL-15 | ITCPPPMSVEHADIWVKSYSLYSRERYICNSGFKR KAGTSSLTECVLNKATNVAHWTTPSLKCIRDPAL VHQRPAPPSTVTTAGVTPQPESLSPSGKEPAAS | 380 |
| IL-15 | ITCPPPMSVEHADIWVKSYSLYSRERYICNSGFKR KAGTSSLTECVLNKATNVAHWTTPSLKCIRDPAL VHQRPAPPS | 381 |
| IL-15 | MAPRRARGCRTLGLPALLLLLLLRPPATRGITCPP PMSVEHADIWVKSYSLYSRERYICNSGFKRKAG TSSLTECVLNKATNVAHWTTPSLKCIRDPALVHQ RPAPPSTVTTAGVTPQPESLSPSGKEPAASSPSSN NTAATTAAIVPGSQLMPSKSPSTGTTEISSHESSH GTPSQTTAKNWELTASASHQPPGVYPQGHSDTT VAISTSTVLLCGLSAVSLLACYLKSRQTPPLASVE MEAMEALPVTWGTSSRDEDLENCSHHL | 382 |
| IL-2 | AVKNCSHLECFYNSRANVSCMWSHEEALNVTT CHVHAKSNLRHWNKTCELTLVRQASWACNLIL GSFPESQSLTSVDLLDINVVCWEEKGWRRVKTC DFHPFDNLRLVAPHSLQVLHIDTQRCNISWKVSQ VSHYIEPYLEFEARRRLLGHSWEDASVLSLKQRQ QWLFLEMLIPSTSYEVQVRVKAQRNNTGTW SPWSQPLTFRTRPADPMKE | 383 |
| IL-2 | AVNGTSQFTCFYNSRANISCVWSQDGALQDTSC QVHAWPDRRRWNQTCELLPVSQASWACNLILG APDSQKLTTVDIVTLRVLCREGVRWRVMAIQDF KPFENLRLMAPISLQVVHVETHRCNISWEISQAS HYFERHLEFEARTLSPGHTWEEAPLLTLKQKQE WICL ETLTPDTQYEFQVRVKPLQGEFTTWSPWSQPLAF RTKPAALGKDT | 384 |
| IL-2 | AVNGTSQFTCFYNSRANISCVWSQDGALQDTSC QVHAWPDRRRWNQTCELLPVSQASWACNLILG APDSQKLTTVDIVTLRVLCREGVRWRVMAIQDF KPFENLRLMAPISLQVVHVETHRCNISWEISQAS HYFERHLEFEARTLSPGHTWEEAPLLTLKQKQE WICLETLTPDTQYEF QVRVKPLQ | 385 |

TABLE 12-continued

Examples of Masking Peptides (PMs) Correlated with Appropriate Cytokines

| Cytokine that may be coupled with the PM | PM Sequence | SEQ ID NO. |
|---|---|---|
| IL-2 | AVNGTSQFTCFYNSRANISCVWSQDGALQDTSC QVHAWPD TABLE 12-continued Examples of Masking Peptides (PMs) Correlated with Appropriate Cytokines

| Cytokine that may be coupled with the PM | PM Sequence | SEQ ID NO. |
|---|---|---|
| IL-2 | ELCDDDPPEIPHATFKAMAYKEGTILNCECKRGF RRIKSGSLYMLCTGNSSHSSWDNQCQCTSSATR NTTKQVTPQPEEQKERKTTEMQSPMQPVDQASL PGHCREPPPWENEATERIYHF TABLE 12-continued Examples of Masking Peptides (PMs) Correlated with Appropriate Cytokines

| Cytokine that may be coupled with the PM | PM Sequence | SEQ ID NO. |
|---|---|---|
| | PGHCREPPPWENEATERIYHFVVGQMVYYQCVQ GYRALHRGPAESVCKMTHGKTRWTQPQLICTGE | |
| IL-2 | ELCDDDPPEIPHATFKAMAYKEGTMLNCECKRG FRRIKSGSLYMLCTGNSSHSSWDNQCQCTSSATR NTTKQVTPQPEEQKERKTTEMQSPMQPVDQASL PGHCREPPPWENEATERIYHFVVGQMVYYQCVQ GYRALHRGPAESVCKMTHGKTRWTQPQLICTGE METSQFPGEEKPQASPEGRPESETSCLVTTTDFQI TABLE 12-continued Examples of Masking Peptides (PMs) Correlated with Appropriate Cytokines

| Cytokine that may be coupled with the PM | PM Sequence | SEQ ID NO. |
|---|---|---|
| IL-2 | ELCDDDPPEIPHATFKAMAYKEGTMLNCECKRG FRRIKSGSVYMLCTGNSSHSSWDNQCQCTSSATR NTTKQVTPQPEEQKERKTTEMQSPMQPVDQASL PGHCREPPPWENEATERIYHFVVGQMVYYQCVQ GYRALHRGPAESVCKMTHGKTRWTQPQLICTGE METSQFPGEEKP TABLE 12-continued Examples of Masking Peptides (PMs) Correlated with Appropriate Cytokines

| Cytokine that may be coupled with the PM | PM Sequence | SEQ ID NO. |
| --- | --- | --- |
| IL-2 | ELCLYDPPEIPHATFKAMAYKEGTMLNCECKRG FRRIKSGSVYMLCTGNSSHSSWDNQCQCTSSATR NTTKQVTPQPEEQKERKTTEMQSPMQPVDQASL PGHCREPPPWENEATERIYHFVVGQMVYYQCVQ GYRALHRGPAESVCKMTHGKTRWTQPQLICTGE METSQFPGEEKPQASPEGRPESETSC | 434 |
| IL-2 | ELCLYDPPEIPHATFKAMAYKEGTMLNCECKRG FRRIKS TABLE 12-continued Examples of Masking Peptides (PMs) Correlated with Appropriate Cytokines

| Cytokine that may be coupled with the PM | PM Sequence | SEQ ID NO. |
|---|---|---|
| | DQASLPGHCREPPPWENEATERIYHFVVGQMVY YQCVQGYRALHRGPAESVCKMTHGKTRWTQPQ LICTGEASGGGGHHHHHH | |
| IL-2 | GMLSLELCDDDPPEIPHATFKAMAYKEGTMLNC ECKRGFRRIKSGSLYMLCTGSSSHSSWDNQCQCT SSATRSTTKQVTPQPEEQKERKTTEMQSPMQPV DQASLPGHCREPPPWENEATERIYHFVVGQMVY YQCVQGYRALHRGPAESVCKMTHGKTRWTQPQ LICTGEAS | 445 |
| IL-2 | GMLSLELCDDDPPEIPHATFKAMAYKEGTMLNC ECKRGFRRIKSGSLYMLCTGSSSHSSWDNQCQCT SSATRSTTKQVTPQPEEQKERKTTEMQSPMQPV DQASLPGHCREPPPWENEATERIYHFVVGQMVY YQCVQGYRALHRGPAESVCKMTHGKTRWTQPQ LICTGEASGGGGHHHHHH | 446 |
| IL-2 | LNTTILTPNGNEDTTADFFLTTMPTDSLSVSTLPL PEVQCFVFNVEYMNCTWNSSSEPQPTNLTLHYW YKNSDNDKVQKCSHYLFSEEITSGCQLQKKEIHL YQTFVVQLQDPREPRRQATQMLKLQNLVIPWAP ENLTLHKLSESQLELNWNNRFLNHCLEHLVQYR TDWDHSWTEQSVDYRHKFSLPSVDGQKRYTFR VRSRFNPLCGSAQHWSEWSHPIHWGSNTSKENP FLFALEAV | 447 |
| IL-2 | MDSYLLMWGLLTFIMVPGCQAELCDDDPPEIPH ATFKAMAYKEGTMLNCECKRGFRRIKSGSLYML CTGNSSHSSWDNQCQCTSSATRNTTKQVTPQPE EQKERKTTEMQSPMQPVDQASLPGHCREPPPWE NEATERIYHFVVGQMVYYQCVQGYRALHRGPA ESVCKMTHGKTRWTQPQLICTGEMETSQFPGEE KPQASPEGRPESETSCLVTTTDFQIQTEMAATME TSIFTTEYQVAVAGCVFLLISVLLLSGLTWQRRQ RKSRRTI | 448 |
| IL-2 | MLSLELCDDDPPEIPHATFKAMAYKEGTMLNCE CKRGFRRIKSGSLYMLCTGSSSHSSWDNQCQCTS SATRSTTKQVTPQPEEQKERKTTEMQSPMQPVD QASLPGHCREPPPWENEATERIYHFVVGQMVYY QCVQGYRALHRGPAESVCKMTHGKTRWTQPQL ICTGE | 449 |
| IL-2 | QKLTTVDI | 450 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR EDWLGEADYGMDVWGQGTTVTVSS | 451 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR DGEQWRGFDYWGQGTTVTVSS | 452 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR DQEQWRLAFDYWGQGTTVTVSS | 453 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR GAVAGTGRDYYYYGMDVWGQGTTVTVSS | 454 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR GSYYDSSGYYYGEDFDYWGQGTTVTVSS | 455 |
| IL-2 | QVQLVESGGGVVQPGRSLRLSCAASGFTFSIYGM HWVRQAPGKGLEWVTVIWYDGSNEYYADSVK | 456 |

TABLE 12-continued

Examples of Masking Peptides (PMs) Correlated with Appropriate Cytokines

| Cytokine that may be coupled with the PM | PM Sequence | SEQ ID NO. |
|---|---|---|
| | GRFTISRDNSKNTLYLQMNSLRAEDTAVYYCAR EEWELEDYGMDVWGQGTTVTVSS | |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR DNWGSDAFDIWGQGTTVTVSS | 457 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR DDWFGEADYGMDVWGQGTTVTVSS | 458 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR RISITPFDYWGQGTTVTVSS | 459 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR DDFWSDYPFDYWGQGTTVTVSS | 460 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR EEWFGEADYGMDVWGQGTTVTVSS | 461 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR GSYYDSSGYYFGEDFDYWGQGTTVTVSS | 462 |
| IL-2 | QVQLVESGGGVVQPGRSLRLSCAASGFTFSIYGM HWVRQAPGKGLEWVTVIWYDGSNEYYADSVK GRFTISRDNSKNTLYLQMNSLRAEDTAVYYCAR GTVAGTGRDYYYYGMDVWGQGTTVTVSS | 463 |
| IL-2 | QVQLVESGGGVVQPGRSLRLSCAASGFTFSSYG MHWVRQAPGKGLEWVAVIWYDGSNKYYADS KGRFTISRDNSKNTLYLQMNSLRAEDTAVYYCA REDFDSHYGMDVWGQGTTVTVSS | 464 |
| IL-2 | SHYFER | 465 |
| IL-2 | TLPLPEVQCFVFNVEYMNCTWNSSSEPQPTNLTL HYWYKNSDNDKVQKCSHYLFSEEITSGCQLQKK EIHLYQTFVVQLQDPREPRRQATQMLKLQNLVIP WAPENLTLHKLSESQLELNWNNRFLNHCLEHLV QYRTDWDHSWTEQSVDYRHKFSLPSVDGQKRY TFRVRSRFNPLCGSAQHWSEWSHPIHWGSNT | 466 |
| IL-2 | TLPLPEVQCFVFNVEYMNCTWNSSSEPQPTNLTL HYWYKNSDNDKVQKCSHYLFSEEITSGCQLQKK EIHLYQTFVVQLQDPREPRRQATQMLKLQNLVI | 467 |
| IL-2 | WSSKVLMSSANEDIKADLILTSTAPEHLSAPTLPL PEVQCFVFNIEYMNCTWNSSSEPQATNLTLHYR YKVSDNNTFQECSHYLFSKEITSGCQIQKEDIQLY QTFVVQLQDPQKPQRRAVQKLNLQNLVIPRAPE NLTLSNLSESQLELRWKSRHIKERCLQYLVQYRS NRDRSWTELIVNHEPRFSLPSVDELKRYTFRVRS RYNPICGSSQQWSKWSQPVHWGSHTVEENPSLF ALEA | 468 |
| IL-2 and IL-15 | AVNGTSQFTCFYNSRANISCVWSQDGALQDTSC QVHAWPDRRRWNQTCELLPVSQASWACNLILG APDSQKLTTVDIVTLRVLCREGVRWRVMAIQDF KPFENLRLMAPISLQVVHVETHRCNISWEISQAS HYFERHLEFEARTLSPGHTWEEAPLLTLKQKQE WICLETLTPDTQYEFQVRVKPLQGEFTTWSPWSQ PLAFRTKPAALGKDTGGGGSGGGGSGGGGSISS GLLSSGGS TABLE 12-continued Examples of Masking Peptides (PMs) Correlated with Appropriate Cytokines

| Cytokine that may be coupled with the PM | PM Sequence | SEQ ID NO. |
|---|---|---|
| | LTPNGNEDTTADFFLTTMPTDSLSVSTLPLPEVQ CFVFNVEYMNCTWNSSSEPQPTNLTLHYWYKNS DNDKVKCSHYLFSEEITSGCQLQKKEIHLYQTFV VQLQDPREPRRQATQMLKLQNLVIPWAPENLTL HKLSESQLELNWNNRFLNHCLEHLVQYRTDWD HSWTEQSVDYRHKFSLPSVDGQKRYTFRVRSRF NPLCGSAQHWSEWSHPIHWGSNTSKENPFLFAL EA | |
| IL-2 and IL-15 | AVNGTSQFTCFYNSRANISCVWSQDGALQDTSC QVHAWPDRRRWNQTCELLPVSQASWACNLILG APDSQKLTTVDIVTLRVLCREGVRWRVMAIQDF KPFENLRLMAPISLQVVHVETHRCNISWEISQAS HYFERHLEFEARTLSPGHTWEEAPLLTLKQKQE WICLETLTPDTQYEFQVRVKPLQGEFTTWSPWSQ PLAFRTKPAALGKDTGGGGSGGGGSGGGGSISS GLLSSGGSGGSLSGRSDNHGGGGSGGGGSAVNG TSQFTCFYNSRANISCVWSQDGALQDTSCQVHA WPDRRRWNQTCELLPVSQASWACNLILGAPDSQ KLTTVDIVTLRVLCREGVRWRVMAIQDFKPFEN LRLMAPISLQVVHVETHRCNISWEISQASHYFER HLEFEARTLSPGHTWEEAPLLTLKQKQEWICLET LTPDTQYEFQVRVKPLQGEFTTWSPWSQPLAFRT KPAALGKDT | 470 |
| IL-2 and IL-15 | AVNGTSQFTCFYNSRANISCVWSQDGALQDTSC QVHAWPDRRRWNQTCELLPVSQASWACNLILG APESQKLTTVDIVTLRVLCREGVRWRVMAIQDF KPFENLRLMAPISLQVVHVETHRCNISWEISQAS HYFERHLEFEARTLSPGHTWEEAPLLTLKQKQE WICLETLTPDTQYEFQVRVKPLQGEFTTWSPWSQ PLAFRTKPAALGKDT | 471 |
| IL-2 and IL-15 | AVNGTSQFTCFYNSRANISCVWSQDGALQDTSC QVHAWPDRRRWNQTCELLPVSQASWACNLILG APDHQKLTTVDIVTLRVLCREGVRWRVMAIQDF KPFENLRLMAPISLQVVHVETHRCNISWEISQAS vHYFERHLEFEARTLSPGHTWEEAPLLTLKQKQE WICLETLTPDTQYEFQVRVKPLQGEFTTWSPWSQ PLAFRTKPAALGKDT | 472 |
| IL-2 and IL-15 | AVNGTSQFTCFYNSRANISCVWSQDGALQDTSC QVHAWPDRRRWNQTCELLPVSQASWACNLILG APDSQKLTTQDIVTLRVLCREGVRWRVMAIQDF KPFENLRLMAPISLQVVHVETHRCNISWEISQAS HYFERHLEFEARTLSPGHTWEEAPLLTLKQKQE WICLETLTPDTQYEFQVRVKPLQGEFTTWSPWSQ PLAFRTKPAALGKDT | 473 |
| IL-2 and IL-15 | AVNGTSQFTCFYNSRANISCVWSQDGALQDTSC QVHAWPDRRRWNQTCELLPVSQASWACNLILG APDSQKLTTFDIVTLRVLCREGVRWRVMAIQDF KPFENLRLMAPISLQVVHVETHRCNISWEISQAS HYFERHLEFEARTLSPGHTWEEAPLLTLKQKQE WICLETLTPDTQYEFQVRVKPLQGEFTTWSPWSQ PLAFRTKPAALGKDT | 474 |
| IL-2 and IL-15 | AVNGTSQFTCFYNSRANISCVWSQDGALQDTSC QVHAWPDRRRWNQTCELLPVSQASWACNLILG APDSQKLTTVDIVTLRVLCREGVRWRVMAIQDF KPFENLRLMAPISLQVVHVETHRCNISWETSQAS HYFQRHLEFEARTLSPGHTWEEAPLLTLKQKQE WICLETLTPDTQYEFQVRVKPLQGEFTTWSPWSQ PLAFRTKPAALGKDT | 475 |
| IL-2 and IL-15 | AVNGTSQFTCFYNSRANISCVWSQDGALQDTSC QVHAWPDRRRWNQTCELLPVSQASWACNLILG APDSQKLTTVDIVTLRVLCREGVRWRVMAIQDF KPFENLRLMAPISLQVVHVETHRCNISWETSQAS | 476 |

TABLE 12-continued

Examples of Masking Peptides (PMs) Correlated with Appropriate Cytokines

| Cytokine that may be coupled with the PM | PM Sequence | SEQ ID NO. |
|---|---|---|
| | HYFQRRLEFEARTLSPGHTWEEAPLLTLKQKQE WICLETLTPDTQYEFQVRVKPLQGEFTTWSPWSQ PLAFRTKPAALGKDT | |
| IL-2 and IL-15 | AVNGTSQFTCFYNSYANISCVWSQDGALQDTSC QVHAWPDRRRWNQTCELLPVSQASWACNLILG APDSQKLTTVDIVTLRVLCREGVRWRVMAIQDF KPFENLRLMAPISLQVVHVETHRCNISWETSQAS HYFERHLEFEARTLSPGHTWEEAPLLTLKQKQE WICLETLTPDTQYEFQVRVKPLQGEFTTWSPWSQ PLAFRTKPAALGKDT | 477 |
| IL-2, IL-15, and IL-21 | LNTTILTPNGNEDTTADFFLTTMPTDSLSVSTLPL PEVQCFVFNVEYMNCTWNSSSEPQPTNLTLHYW YKNSDNDKVQKCSHYLFSEEITSGCQLQKKEIHL YQTFVVQLQDPREPRRQATQMLKLQNLVIPWAP ENLTLHKLSESQLELNWNNRFLNHCLEHLVQYR TDWDHSWTEQSVDYRHKFSLPSVDGQKRYTFR VRSRFNPLCGSAQHWSEWSHPIHWGSNTSKENP FLFALEA | 478 |
| IL-21 | CPDLVCYTDYLQTVICILEMWNLHPSTLTLTWQ DQYEELKDEATSCSLHRSAHNATHATYTCHMDV FHFMADDIFSVNITDQSGNYSQECGSFLLAESIKP APPFNVTVTFSGQYNISWRSDYEDPAFYMLKGK LQYELQYRNRGDPWAVSPRRKLISVDSRSVSLLP LEFRKDSSYELQVRAGPMPGSSYQGTWSEWSDP VIFQTQSEELKE | 479 |

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (501 sequences)

SEQ ID NO: 1 - protein, 165 aa, Homo sapiens [sequence omitted]

SEQ ID NO: 2 - protein, 4 aa, Artificial Sequence
  Linker
GGGS

SEQ ID NO: 3 - protein, 219 aa, Homo sapiens
CPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 4 - protein, 226 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 5 - protein, 8 aa, Artificial Sequence
  Clevable moiety
LSGRSDNH

SEQ ID NO: 6 - protein, 8 aa, Artificial Sequence
  Cleavable moiety
TGRGPSWV

SEQ ID NO: 7 - protein, 8 aa, Artificial Sequence
  Cleavable moiety
PLTGRSGG

SEQ ID NO: 8 - protein, 8 aa, Artificial Sequence
  Cleavable moiety
TARGPSFK

SEQ ID NO: 9 - protein, 12 aa, Artificial Sequence
  Cleavable moiety
NTLSGRSENHSG

SEQ ID NO: 10 - protein, 12 aa, Artificial Sequence
  Cleavable moiety
NTLSGRSGNHGS

SEQ ID NO: 11 - protein, 12 aa, Artificial Sequence
  Cleavable moiety
TSTSGRSANPRG

SEQ ID NO: 12 - protein, 8 aa, Artificial Sequence
  Cleavable moiety
TSGRSANP

SEQ ID NO: 13 - protein, 10 aa, Artificial Sequence
  Cleavable moiety
VHMPLGFLGP

SEQ ID NO: 14 - protein, 8 aa, Artificial Sequence
  Cleavable moiety
AVGLLAPP

SEQ ID NO: 15 - protein, 8 aa, Artificial Sequence
  Cleavable moiety
AQNLLGMV

SEQ ID NO: 16 - protein, 8 aa, Artificial Sequence
  Cleavable moiety
QNQALRMA

SEQ ID NO: 17 - protein, 8 aa, Artificial Sequence
  Cleavable moiety
LAAPLGLL

SEQ ID NO: 18 - protein, 8 aa, Artificial Sequence
  Cleavable moiety
STFPFGMF

SEQ ID NO: 19 - protein, 8 aa, Artificial Sequence
  Cleavable moiety
ISSGLLSS

SEQ ID NO: 20 - protein, 8 aa, Artificial Sequence
  Cleavable moiety
PAGLWLDP

SEQ ID NO: 21 - protein, 8 aa, Artificial Sequence
  Cleavable moiety
VAGRSMRP

SEQ ID NO: 22 - protein, 8 aa, Artificial Sequence
  cleavable moiety
VVPEGRRS

SEQ ID NO: 23 - protein, 8 aa, Artificial Sequence
  Cleavable moiety
ILPRSPAF

SEQ ID NO: 24 - protein, 8 aa, Artificial Sequence
  Clevable moiety
MVLGRSLL

SEQ ID NO: 25 - protein, 8 aa, Artificial Sequence
  Cleavable moiety
QGRAITFI

SEQ ID NO: 26 - protein, 8 aa, Artificial Sequence
  Cleavable moiety
SPRSIMLA

SEQ ID NO: 27 - protein, 8 aa, Artificial Sequence
  Cleavable moiety
SMLRSMPL

SEQ ID NO: 28 - protein, 13 aa, Artificial Sequence
  Cleavable moiety
ISSGLLSGRSDNH

SEQ ID NO: 29 - protein, 18 aa, Artificial Sequence
  Cleavable moiety
AVGLLAPPGGLSGRSDNH

SEQ ID NO: 30 - protein, 22 aa, Artificial Sequence
  Cleavable moiety
ISSGLLSSGGSGGSLSGRSDNH

SEQ ID NO: 31 - protein, 8 aa, Artificial Sequence
  Cleavable moiety
LSGRSGNH

SEQ ID NO: 32 - protein, 9 aa, Artificial Sequence
  Cleavable moeity
SGRSANPRG

SEQ ID NO: 33 - protein, 8 aa, Artificial Sequence
  Cleavable moiety
LSGRSDDH

SEQ ID NO: 34 - protein, 8 aa, Artificial Sequence
  Cleavable moiety
LSGRSDIH

SEQ ID NO: 35 - protein, 8 aa, Artificial Sequence
  Cleavable moiety
LSGRSDQH

SEQ ID NO: 36 - protein, 8 aa, Artificial Sequence
  Cleavable moiety
LSGRSDTH

SEQ ID NO: 37 - protein, 8 aa, Artificial Sequence
  Cleavable moiety
LSGRSDYH

SEQ ID NO: 38 - protein, 8 aa, Artificial Sequence
  Cleavable moiety
LSGRSDNP

SEQ ID NO: 39 - protein, 8 aa, Artificial Sequence
  Cleavable moiety
LSGRSANP

SEQ ID NO: 40 - protein, 8 aa, Artificial Sequence
  Cleavable moiety
LSGRSANI

SEQ ID NO: 41 - protein, 8 aa, Artificial Sequence
  Cleavable moiety
LSGRSDNI

SEQ ID NO: 42 - protein, 8 aa, Artificial Sequence
  Cleavable moiety
MIAPVAYR

SEQ ID NO: 43 - protein, 8 aa, Artificial Sequence
  Cleavable moiety
RPSPMWAY

SEQ ID NO: 44 - protein, 8 aa, Artificial Sequence
  Cleavable moiety
WATPRPMR

SEQ ID NO: 45 - protein, 8 aa, Artificial Sequence
  Cleavable moiety
FRLLDWQW

SEQ ID NO: 46 - protein, 5 aa, Artificial Sequence
  Cleavable moiety
ISSGL

SEQ ID NO: 47 - protein, 7 aa, Artificial Sequence
  Cleavable moiety
ISSGLLS

SEQ ID NO: 48 - protein, 6 aa, Artificial Sequence
  Cleavable moiety
ISSGLL

SEQ ID NO: 49 - protein, 15 aa, Artificial Sequence
  Cleavable moiety
ISSGLLSGRSANPRG

SEQ ID NO: 50 - protein, 18 aa, Artificial Sequence
  Cleavable moiety
AVGLLAPPTSGRSANPRG

SEQ ID NO: 51 - protein, 17 aa, Artificial Sequence
  Cleavable moiety
AVGLLAPPSGRSANPRG

SEQ ID NO: 52 - protein, 13 aa, Artificial Sequence
  Cleavable moiety
ISSGLLSGRSDDH

SEQ ID NO: 53 - protein, 13 aa, Artificial Sequence
  Cleavable moiety
ISSGLLSGRSDIH

SEQ ID NO: 54 - protein, 13 aa, Artificial Sequence
  Cleavable moiety
ISSGLLSGRSDQH

SEQ ID NO: 55 - protein, 13 aa, Artificial Sequence
  Cleavable moiety
ISSGLLSGRSDTH

SEQ ID NO: 56 - protein, 13 aa, Artificial Sequence
  Cleavable moiety
ISSGLLSGRSDYH

SEQ ID NO: 57 - protein, 13 aa, Artificial Sequence
  Cleavable moiety
ISSGLLSGRSDNP

SEQ ID NO: 58 - protein, 13 aa, Artificial Sequence
  Cleavable moiety
ISSGLLSGRSANP

SEQ ID NO: 59 - protein, 13 aa, Artificial Sequence
  Cleavable moiety
ISSGLLSGRSANI

SEQ ID NO: 60 - protein, 18 aa, Artificial Sequence
  Cleavable moiety
AVGLLAPPGGLSGRSDDH

SEQ ID NO: 61 - protein, 18 aa, Artificial Sequence
  Cleavable moiety
AVGLLAPPGGLSGRSDIH

SEQ ID NO: 62 - protein, 18 aa, Artificial Sequence
  Cleavable moiety
AVGLLAPPGGLSGRSDQH

SEQ ID NO: 63 - protein, 18 aa, Artificial Sequence
  Cleavable moiety
AVGLLAPPGGLSGRSDTH

SEQ ID NO: 64 - protein, 18 aa, Artificial Sequence
  Cleavable moeity
AVGLLAPPGGLSGRSDYH

SEQ ID NO: 65 - protein, 18 aa, Artificial Sequence
  Cleavable moiety
AVGLLAPPGGLSGRSDNP

SEQ ID NO: 66 - protein, 18 aa, Artificial Sequence
  Cleavable moiety
AVGLLAPPGGLSGRSANP

SEQ ID NO: 67 - protein, 18 aa, Artificial Sequence
  Cleavable moiety
AVGLLAPPGGLSGRSANI

SEQ ID NO: 68 - protein, 13 aa, Artificial Sequence
  Cleavable moiety
ISSGLLSGRSDNI

SEQ ID NO: 69 - protein, 18 aa, Artificial Sequence
  Cleavable moiety
AVGLLAPPGGLSGRSDNI

SEQ ID NO: 70 - protein, 19 aa, Artificial Sequence
  Cleavable moiety
GLSGRSDNHGGAVGLLAPP

SEQ ID NO: 71 - protein, 21 aa, Artificial Sequence
  Cleavable moiety
GLSGRSDNHGGVHMPLGFLGP

SEQ ID NO: 72 - protein, 20 aa, Artificial Sequence
  Cleavable moiety
LSGRSDNHGGVHMPLGFLGP

SEQ ID NO: 73 - protein, 7 aa, Artificial Sequence
  Cleavable moiety
ISSGLSS

SEQ ID NO: 74 - protein, 8 aa, Artificial Sequence
  Cleavable moiety
PVGYTSSL

SEQ ID NO: 75 - protein, 8 aa, Artificial Sequence
  Cleavable moiety
DWLYWPGI

SEQ ID NO: 76 - protein, 8 aa, Artificial Sequence
  Cleavable moiety
LKAAPRWA

SEQ ID NO: 77 - protein, 8 aa, Artificial Sequence
  Cleavable moiety
GPSHLVLT

SEQ ID NO: 78 - protein, 8 aa, Artificial Sequence
  Cleavable moiety
LPGGLSPW

SEQ ID NO: 79 - protein, 8 aa, Artificial Sequence
  Cleavable moiety
MGLFSEAG

SEQ ID NO: 80 - protein, 8 aa, Artificial Sequence
  Cleavable moiety
SPLPLRVP

SEQ ID NO: 81 - protein, 8 aa, Artificial Sequence
  Cleavable moiety
RMHLRSLG

SEQ ID NO: 82 - protein, 8 aa, Artificial Sequence
  Cleavable moiety
LLAPSHRA

SEQ ID NO: 83 - protein, 7 aa, Artificial Sequence
  Cleavable moiety
GPRSFGL

SEQ ID NO: 84 - protein, 6 aa, Artificial Sequence
  Cleavable moiety
GPRSFG

SEQ ID NO: 85 - protein, 8 aa, Artificial Sequence
  Cleavable moiety
SARGPSRW

SEQ ID NO: 86 - protein, 8 aa, Artificial Sequence
  Cleavable moiety
GGWHTGRN

SEQ ID NO: 87 - protein, 8 aa, Artificial Sequence
  Cleavable moiety
HTGRSGAL

SEQ ID NO: 88 - protein, 8 aa, Artificial Sequence
  Cleavable moiety
AARGPAIH

SEQ ID NO: 89 - protein, 8 aa, Artificial Sequence
  Cleavable moiety
RGPAFNPM

SEQ ID NO: 90 - protein, 8 aa, Artificial Sequence
  Cleavable moiety
SSRGPAYL

SEQ ID NO: 91 - protein, 8 aa, Artificial Sequence
  Cleavable moiety
RGPATPIM

SEQ ID NO: 92 - protein, 4 aa, Artificial Sequence
  Cleavable moiety
RGPA

SEQ ID NO: 93 - protein, 10 aa, Artificial Sequence
  Cleavable moiety
GGQPSGMWGW

SEQ ID NO: 94 - protein, 10 aa, Artificial Sequence
  Cleavable moiety
FPRPLGITGL

SEQ ID NO: 95 - protein, 8 aa, Artificial Sequence
  Cleavable moiety
SPLTGRSG

SEQ ID NO: 96 - protein, 8 aa, Artificial Sequence
  Cleavable moiety
SAGFSLPA

SEQ ID NO: 97 - protein, 9 aa, Artificial Sequence
  Cleavable moiety
LAPLGLQRR

SEQ ID NO: 98 - protein, 8 aa, Artificial Sequence
  Cleavable moiety
SGGPLGVR

SEQ ID NO: 99 - protein, 4 aa, Artificial Sequence
  Cleavable moiety
PLGL

SEQ ID NO: 100 - protein, 7 aa, Artificial Sequence
  Cleavable moiety
SGRSDNI

SEQ ID NO: 101 - protein, 165 aa, Homo sapiens
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 102 - protein, 169 aa, Rattus rattus
CDLPHTHNLRNKRAFTLLAQMRRLSPVSCLKDRKDFGFPLEKVDGQQIQKAQAIPVLHELTQQILSLFTSKESSTAWDASLLDSFCNDLQQQLSGLQACLMQQVGVQESPLTQEDSLLAVREYFHRITVYLREKKHSPCAWEVVRAEVWRALSSSANLLGRLREERNES

SEQ ID NO: 103 - protein, 167 aa, Mus musculus
CDLPHTYNLRNKRALKVLAQMRRLPFLSCLKDRQDFGFPLEKVDNQQIQKAQAIPVLRDLTQQTLNLFTSKASSAAWNATLLDSFCNDLHQQLNDLQTCLMQQVGVQEPPLTQEDALLAVRKYFHRITVYLREKKHSPCAWEVVRAEVWRALSSSVNLLPRLSEEKE

SEQ ID NO: 104 - protein, 165 aa, Homo sapiens [sequence omitted]

SEQ ID NO: 105 - protein, 495 aa, Homo sapiens
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKECDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMNEDSILAVRKYFQRITLYLKEKKYSPCAWEVVRAEIMRSFSLSTNLQESLRSKECDLPQTHSLGSRRTLMLLAQMRRISLFSCLKDRRDFGFPQEEFGNQFQKAETIPVLHEMIQQIFNLFSTKDSSAAWDETLLDKFYTELYQQLNDLEACVIQGVGVTETPLMNEDSILAVRKYFQRITLYLKEKKYSPCAWEVVRAEIMRSFSLSTNLQESLRSKE

SEQ ID NO: 106 - protein, 166 aa, Homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 107 - protein, 165 aa, Homo sapiens
SYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 108 - protein, 182 aa, Mus musculus
MNNRWILHAAFLLCFSTTALSINYKQLQLQERTNIRKCQELLEQLNGKINLTYRADFKIPMEMTEKMQKSYTAFAIQEMLQNVFLVFRNNFSSTGWNETIVVRLLDELHQQTVFLKTVLEEKQEERLTWEMSSTALHLKSYYWRVQRYLKLMKYNSYAWMVVRAEIFRNFLIIRRLTRNFQN

SEQ ID NO: 109 - protein, 184 aa, Rattus rattus
MANRWTLHIAFLLCFSTTALSIDYKQLQFRQSTSIRTCQKLLRQLNGRLNLSYRTDFKIPMEVMHPSQMEKSYTAFAIQVMLQNVFLVFRSNFSSTGWNETIVESLLDELHQQTELLEIILKEKQEERLTWVTSTTTLGLKSYYWRVQRYLKDKKYNSYAWMVVRAEVFRNFSIILRLNRNFQN

SEQ ID NO: 110 - protein, 173 aa, Homo sapiens
MCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 111 - protein, 271 aa, Homo sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 112 - protein, 270 aa, Mus musculus
MAKVPDLFEDLKNCYSENEDYSSAIDHLSLNQKSFYDASYGSLHETCTDQFVSLRTSETSKMSNFTFKESRVTVSATSSNGKILKKRRLSFSETFTEDDLQSITHDLEETIQPRSAPYTYQSDLRYKLMKLVRQKFVMNDSLNQTIYQDVDKHYLSTTWLNDLQQEVKFDMYAYSSGGDDSKYPVTLKISDSQLFVSAQGEDQPVLLKELPETPKLITGSETDLIFFWKSINSKNYFTSAAYPELFIATKEQSRVHLARGLPSMTDFQIS

SEQ ID NO: 113 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 114 - protein, 269 aa, Mus musculus
MATVPELNCEMPPFDSDENDLFFEVDGPQKMKGCFQTFDLGCPDESIQLQISQQHINKSFRQAVSLIVAVEKLWQLPVSFPWTFQDEDMSTFFSFIFEEEPILCDSWDDDDNLLVCDVPIRQLHYRLRDEQQKSLVLSDPYELKALHLNGQNINQQVIFSMSFVQGEPSNDKIPVALGLKGKNLYLSCVMKDGTPTLQLESVDPKQYPKKKMEKRFVFNKIEVKSKVEFESAEFPNWYISTSQAEHKPVFLGNNSGQDIIDFTMESVSS

SEQ ID NO: 115 - protein, 177 aa, Homo sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 116 - protein, 178 aa, Mus musculus
MEICWGPYSHLISLLLILLFHSEAACRPSGKRPCKMQAFRIWDTNQKTFYLRNNQLIAGYLQGPNIKLEEKIDMVPIDLHSVFLGIHGGKLCLSCAKSGDDIKLQLEEVNITDLSKNKEEDKRFTFIRSEKGPTTSFESAACPGWFLCTTLEADRPVSLTNTPEEPLIVTKFYFQEDQ

SEQ ID NO: 117 - protein, 193 aa, Homo sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 118 - protein, 192 aa, Mus musculus
MAAMSEDSCVNFKEMMFIDNTLYFIPEENGDLESDNFGRLHCTTAVIRNINDQVLFVDKRQPVFEDMTDIDQSASEPQTRLIIYMYKDSEVRGLAVTLSVKDSKMSTLSCKNKIISFEEMDPPENIDDIQSDLIFFQKRVPGHNKMEFESSLYEGHFLACQKEDDAFKLILKKKDENGDKSVMFTLTNLHQS

SEQ ID NO: 119 - protein, 150 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIIS

SEQ ID NO: 120 - protein, 169 aa, Mus musculus
MYSMQLASCVTLTLVLLVNSAPTSSSTSSSTAEAQQQQQQQQQQQQHLEQLLMDLQELLSRMENYRNLKLPRMLTFKFYLPKQATELKDLQCLEDELGPLRHVLDLTQSKSFQLEDAENFISNIRVTVVKLKGSDNTFECQFDDESATVVDFLRRWIAFCQSIISTSPQ

SEQ ID NO: 121 - protein, 153 aa, Homo sapiens [sequence omitted]

SEQ ID NO: 122 - protein, 140 aa, Mus musculus
MGLNPQLVVILLFFLECTRSHIHGCDKNHLREIIGILNEVTGEGTPCTEMDVPNVLTATKNTTESELVCRASKVLRIFYLKHGKTPCLKKNSSVLMELQRLFRAFRCLDSSISCTMNESKSTSLKDFLESLKSIMQMDYS

SEQ ID NO: 123 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 124 - protein, 154 aa, Mus musculus
MFHVSFRYIFGIPPLILVLLPVTSSECHIKDKEGKAYESVLMISIDELDKMTGTDSNCPNNEPNFFRKHVCDDTKEAAFLNRAARKLKQFLKMNISEEFNVHLLTVSQGTQTLVNCTSKEEKNVKEQKKNDACFLKRLLREIKTCWNKILKGSI

SEQ ID NO: 125 - protein, 144 aa, Homo sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 126 - protein, 144 aa, Mus musculus
MLVTYILASVLLFSSVLGQRCSTTWGIRDTNYLIENLKDDPPSKCSCSGNVTSCLCLSVPTDDCTTPCYREGLLQLTNATQKSRLLPVFHRVKRIVEVLKNITCPSFSCEKPCNQTMAGNTLSFLKSLLGTFQKTEMQRQKSRP

SEQ ID NO: 127 - protein, 146 aa, Homo sapiens [sequence omitted]

SEQ ID NO: 128 - protein, 131 aa, Mus musculus
MALWVTAVLALACLGGLAAPGPVPRSVSLPLTLKELIEELSNITQDQTPLCNGSMVWSVDLAAGGFCVALDSLTNISNCNAIYRTQRILHGLCNRKAPTTVSSLPDTKIEVAHFITKLLSYTKQLFRHGPF

SEQ ID NO: 129 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 130 - protein, 162 aa, Mus musculus
MKILKPYMRNTSISCYLCFLLNSHFLTEAGIHVFILGCVSVGLPKTEANWIDVRYDLEKIESLIQSIHIDTTLYTDSDFHPSCKVTAMNCFLLELQVILHEYSNMTLNETVRNVLYLANSTLSSNKNVAESGCKECEELEEKTFTEFLQSFIRIVQMFINTS

SEQ ID NO: 131 - protein, 152 aa, Homo sapiens
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 132 - protein, 166 aa, Mus musculus
MVLASSTTSIHTMLLLLLMLFHLGLQASISGRDTHRLTRTLNCSSIVKEIIGKLPEPELKTDDEGPSLRNKSFRRVNLSKFVESQGEVDPEDRYVIKSNLQKLNCCLPTSANDSALPGVFIRDLDDFRKKLRFYMVHLNDLETVLTSRPPQPASGSVSPNRGTVEC

SEQ ID NO: 133 - protein, 134 aa, Homo sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 134 - protein, 133 aa, Mus musculus
MRRMLLHLSVLTLSCVWATAMEIPMSTVVKETLTQLSAHRALLTSNETMRLPVPTHKNHQLCIGEIFQGLDILKNQTVRGGTVEMLFQNLSLIKKYIDRQKEKCGEERRRTRQFLDYLQEFLGVMSTEWAMEG

SEQ ID NO: 135 - protein, 144 aa, Homo sapiens
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 136 - protein, 141 aa, Mus musculus
MWLQNLLFLGIVVYSLSAPTRSPITVTRPWKHVEAIKEALNLLDDMPVTLNEEVEVVSNEFSFKKLTCVQTRLKIFEQGLRGNFTKLKGALNMTASYYQTYCPPTPETDCETQVTTYADFIDSLKTFLTDIPFECKKPGQK

SEQ ID NO: 137 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 138 - protein, 211 aa, Mus musculus
MKFLSARDFHPVAFLGLMLVTTTAFPTSQVRRGDFTEDTTPNRPVYTTSQVGGLITHVLWEIVEMRKELCNGNSDCMNNDDALAENNLKLPEIQRNDGCYQTGYNQEICLLKISSGLLEYHSYLEYMKNNLKDNKKDKARVLQRDTETLIHIFNQEVKDLHKIVLPTPISNALLTDKLESQKEWLRTKTIQFILKSLEEFLKVTLRSTRQT

SEQ ID NO: 139 - protein, 199 aa, Homo sapiens
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 140 - protein, 199 aa, Mus musculus
MNCVCRLVLVVLSLWPDRVVAPGPPAGSPRVSSDPRADLDSAVLLTRSLLADTRQLAAQMRDKFPADGDHSLDSLPTLAMSAGTLGSLQLPGVLTRLRVDLMSYLRHVQWLRRAGGPSLKTLEPELGALQARLERLLRRLQLLMSRLALPQAAPDQPVIPLGPPASAWGSIRAAHAILGGLHLTLDWAVRGLLLLKTRL

SEQ ID NO: 141 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 142 - protein, 208 aa, Mus musculus
MAQLSAQRRMKLMALQLLLWQSALWSGREAVPLVTVSALPPSLPLPRSFLLKSLEQVRKIQASGSVLLEQLCATYKLCHPEELVLLGHSLGIPKASLSGCSSQALQQTQCLSQLHSGLCLYQGLLQALSGISPALAPTLDLLQLDVANFATTIWQQMENLGVAPTVQPTQSAMPAFTSAFQRRAGGVLAISYLQGFLETARLALHHLA

SEQ ID NO: 143 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 144 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 145 - protein, 335 aa, Mus musculus
MCPQKLTISWFAIVLLVSPLMAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRS

SEQ ID NO: 146 - protein, 215 aa, Mus musculus
MCQSRYLLFLATLALLNHLSLARVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSA

SEQ ID NO: 147 - protein, 202 aa, Homo sapiens
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 148 - protein, 203 aa, Mus musculus [sequence omitted]

SEQ ID NO: 149 - protein, 252 aa, Homo sapiens
MGVLLTQRTLLSLVLALLFPSMASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 150 - protein, 263 aa, Mus musculus
MQTRLLRTLLSLTLSLLILSMALANRGCSNSSSQLLSQLQNQANLTGNTESLLEPYIRLQNLNTPDLRAACTQHSVAFPSEDTLRQLSKPHFLSTVYTTLDRVLYQLDALRQKFLKTPAFPKLDSARHNILGIRNNVFCMARLLNHSLEIPEPTQTDSGASRSTTTPDVFNTKIGSCGFLWGYHRFMGSVGRVFREWDDGSTRSRRQSPLRARRKGTRRIRVRHKGTRRIRVRRKGTRRIWVRRKGSRKIRPSRSTQSPTTRA

SEQ ID NO: 151 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 152 - protein, 178 aa, Mus musculus
MPGSALLCCLLLLTGMRISRGQYSREDNNCTHFPVGQSHMLLELRTAFSQVKTFFQTKDQLDNILLTDSLMQDFKGYLGCQALSEMIQFYLVEVMPQAEKHGPEIKEHLNSLGEKLKTLRMRLRRCHRFLPCENKSKAVEQVKSDFNKLQDQGVYKAMNEFDIFINCIEAYMMIKMKS

SEQ ID NO: 153 - protein, 176 aa, Homo sapiens
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 154 - protein, 176 aa, Mus musculus
MKGFGLAFGLFSAVGFLLWTPLTGLKTLHLGSCVITANLQAIQKEFSEIRDSVQAEDTNIDIRILRTTESLKDIKSLDRCCFLRHLVRFYLDRVFKVYQTPDHHTLRKISSLANSFLIIKKDLSVCHSHMACHCGEEAMEKYNQILSHFIELELQAAVVKALGELGILLRWMEEML

SEQ ID NO: 155 - protein, 546 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 156 - protein, 554 aa, Mus musculus
MKNQDKKNGPAKHSNSKGSPGQREAGPEGAHGRPRQTAPGAEAEGSTSQAPGKTEGARAKAAQPGALCDVSEELSRQLEDILSTYCVDNNQGGPAEEGAQGEPTEPEDTEKSRTYAARNGEPEPGIPVVNGEKETSKGEPGTEEIRASDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKEFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLTAGGITDIGSERRPEATTASKEQGVESPGAQPASSPRATDAPCCSGAPSTGTAGQTGPGEPTPATA

SEQ ID NO: 157 - protein, 1331 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEIVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 158 - protein, 1322 aa, Mus musculus
MEPHGHSGKSRKSTKFRSISRSLILCNAKTSDDGSSPDEKYPDPFETSLCQGKEGFFHSSMQLADTFEAGLSNIPDLALASDSAQLAAAGSDRGKHCRKMFFMKESSSTSSKEKSGKPEAQSSSFLFPKACHQRTRSNSTSVNPYSAGEIDFPMTKKSAAPTDRQPYSLCSNRKSLSQQLDYPILGTARPTRSLSTAQLGQLSGGLQASVISNIVLMKGQAKGLGFSIVGGKDSIYGPIGIYVKSIFAGGAAAADGRLQEGDEILELNGESMAGLTHQDALQKFKQAKKGLLTLTVRTRLTTPPSLCSHLSPPLCRSLSSSTCGAQDSSPFSLESPASPASTAKPNYRIMVEVSLKKEAGVGLGIGLCSIPYFQCISGIFVHTLSPGSVAHLDGRLRCGDEIVEINDSPVHCLTLNEVYTILSHCDPGPVPIIVSRHPDPQVSEQQLKEAVAQAVEGVKFGKDRHQWSLEGVKRLESSWHGRPTLEKEREKHSAPPHRRAQKIMVRSSSDSSYMSGSPGGSPCSAGAEPQPSEREGSTHSPSLSPGEEQEPCPGVPSRPQQESPPLPESLERESHPPLRLKKSFEILVRKPTSSKPKPPPRKYFKNDSEPQKKLEEKEKVTDPSGHTLPTCSQETRELLPLLLQEDTAGRAPCTAACCPGPAASTQTSSSTEGESRRSASPETPASPGKHPLLKRQARMDYSFDITAEDPWVRISDCIKNLFSPIMSENHSHTPLQPNTSLGEEDGTQGCPEGGLSKMDAANGAPRVYKSADGSTVKKGPPVAPKPAWFRQSLKGLRNRAPDPRRPPEVASAIQPTPVSRDPPGPQPQASSSIRQRISSFENFGSSQLPDRGVQRLSLQPSSGETTKFPGKQDGGRFSGLLGQGATVTAKHRQTEVESMSTTFPNSSEVRDPGLPESPPPGQRPSTKALSPDPLLRLLTTQSEDTQGPGLKMPSQRARSFPLTRTQSCETKLLDEKASKLYSISSQLSSAVMKSLLCLPSSVSCGQITCIPKERVSPKSPCNNSSAAEGFGEAMASDTGFSLNLSELREYSEGLTEPGETEDRNHCSSQAGQSVISLLSAEELEKLIEEVRVLDEATLKQLDSIHVTILHKEEGAGLGFSLAGGADLENKVITVHRVFPNGLASQEGTIQKGNEVLSINGKSLKGATHNDALAILRQARDPRQAVIVTRRTTVEATHDLNSSTDSAASASAASDISVESKEATVCTVTLEKTSAGLGFSLEGGKGSLHGDKPLTINRIFKGTEQGEMVQPGDEILQLAGTAVQGLTRFEAWNVIKALPDGPVTIVIRRTSLQCKQTTASADS

SEQ ID NO: 159 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 160 - protein, 158 aa, Mus musculus
MSPGRASSVSLMLLLLLSLAATVKAAAIIPQSSACPNTEAKDFLQNVKVNLKVFNSLGAKVSSRRPSDYLNRSTSPWTLHRNEDPDRYPSVIWEAQCRHQRCVNAEGKLDHHMNSVLIQQEILVLKREPESCPFTFRVEKMLVGVGCTCVASIVRQAA

SEQ ID NO: 161 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 162 - protein, 260 aa, Mus musculus
MIETYSQPSPRSVATGLPASMKIFMYLLTVFLITQMIGSVLFAVYLHRRLDKVEEEVNLHEDFVFIKKLKRCNKGEGSLSLLNCEEMRRQFEDLVKDITLNKEEKKENSFEMQRGDEDPQIAAHVVSEANSNAASVLQWAKKGYYTMKSNLVMLENGKQLTVKREGLYYVYTQVTFCSNREPSSQRPFIVGLWLKPSSGSERILLKAANTHSSSQLCEQQSVHLGGVFELQAGASVFVNVTEASQVIHRVGFSSFGLLKL

SEQ ID NO: 163 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 164 - protein, 306 aa, Mus musculus
MGTRGLQGLGGRPQGRGCLLLAVAGATSLVTLLLAVPITVLAVLALVPQDQGRRVEKIIGSGAQAQKRLDDSKPSCILPSPSSLSETPDPRLHPQRSNASRNLASTSQGPVAQSSREASAWMTILSPAADSTPDPGVQQLPKGEPETDLNPELPAAHLIGAWMSGQGLSWEASQEEAFLRSGAQFSPTHGLALPQDGVYYLYCHVGYRGRTPPAGRSRARSLTLRSALYRAGGAYGRGSPELLLEGAETVTPVVDPIGYGSLWYTSVGFGGLAQLRSGERVYVNISHPDMVDYRRGKTFFGAVMVG

SEQ ID NO: 165 - protein, 232 aa, Homo sapiens
STESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 166 - protein, 138 aa, Mus musculus
NHQVEEQLEWLSQRANALLANGMDLKDNQLVVPADGLYLVYSQVLFKGQGCPDYVLLTHTVSRFAISYQEKVNLLSAVKSPCPKDTPEGAELKPWYEPIYLGGVFQLEKGDQLSAEVNLPKYLDFAESGQVYFGVIAL

SEQ ID NO: 167 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 168 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 169 - protein, 309 aa, Mus musculus
MDQHTLDVEDTADARHPAGTSCPSDAALLRDTGLLADAALLSDTVRPTNAALPTDAAYPAVNVRDREAAWPPALNFCSRHPKLYGLVALVLLLLIAACVPIFTRTEPRPALTITTSPNLGTRENNADQVTPVSHIGCPNTTQQGSPVFAKLLAKNQASLCNTTLNWHSQDGAGSSYLSQGLRYEEDKKELVVDSPGLYYVFLELKLSPTFTNTGHKVQGWVSLVLQAKPQVDDFDNLALTVELFPCSMENKLVDRSWSQLLLLKAGHRLSVGLRAYLHGAQDAYRDWELSYPNTTSFGLFLVKPDNPWE

SEQ ID NO: 170 - protein, 146 aa, Homo sapiens
AVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 171 - protein, 241 aa, Mus musculus
MPASSPGHMGGSVREPALSVALWLSWGAVLGAVTCAVALLIQQTELQSLRREVSRLQRSGGPSQKQGERPWQSLWEQSPDVLEAWKDGAKSRRRRAVLTQKHKKKHSVLHLVPVNITSKADSDVTEVMWQPVLRRGRGLEAQGDIVRVWDTGIYLLYSQVLFHDVTFTMGQVVSREGQGRRETLFRCIRSMPSDPDRAYNSCYSAGVFHLHQGDIITVKIPRANAKLSLSPHGTFLGFVKL

SEQ ID NO: 172 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 173 - protein, 195 aa, Mus musculus
MPEEGRPCPWVRWSGTAFQRQWPWLLLVVFITVFCCWFHCSGLLSKQQQRLLEHPEPHTAELQLNLTVPRKDPTLRWGAGPALGRSFTHGPELEEGHLRIHQDGLYRLHIQVTLANCSSPGSTLQHRATLAVGICSPAAHGISLLRGRFGQDCTVALQRLTYLVHGDVLCTNLTLPLLPSRNADETFFGVQWICP

SEQ ID NO: 174 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 175 - protein, 239 aa, Mus musculus
MEPGLQQAGSCGAPSPDPAMQVQPGSVASPWRSTRPWRSTSRSYFYLSTTALVCLVVAVAIILVLVVQKKDSTPNTTEKAPLKGGNCSEDLFCTLKSTPSKKSWAYLQVSKHLNNTKLSWNEDGTIHGLIYQDGNLIVQFPGLYFIVCQLQFLVQCSNHSVDLTLQLLINSKIKKQTLVTVCESGVQSKNIYQNLSQFLLHYLQVNSTISVRVDNFQYVDTNTFPLDNVLSVFLYSSSD

SEQ ID NO: 176 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 177 - protein, 279 aa, Mus musculus
MQQPMNYPCPQIFWVDSSATSSWAPPGSVFPCPSCGPRGPDQRRPPPPPPPVSPLPPPSQPLPLPPLTPLKKKDHNTNLWLPVVFFMVLVALVGMGLGMYQLFHLQKELAELREFTNQSLKVSSFEKQIANPSTPSEKKEPRSVAHLTGNPHSRSIPLEWEDTYGTALISGVKYKKGGLVINETGLYFVYSKVYFRGQSCNNQPLNHKVYMRNSKYPEDLVLMEEKRLNYCTTGQIWAHSSYLGAVFNLTSADHLYVNISQLSLINFEESKTFFGLYKL

SEQ ID NO: 178 - protein, 199 aa, Homo sapiens
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 179 - protein, 173 aa, Mus musculus
MEEMPLRESSPQRAERCKKSWLLCIVALLLMLLCSLGTLIYTSLKPTAIESCMVKFELSSSKWHMTSPKPHCVNTTSDGKLKILQSGTYLIYGQVIPVDKKYIKDNAPFVVQIYKKNDVLQTLMNDFQILPIGGVYELHAGDNIYLKFNSKDHIQKTNTYWGIILMPDLPFIS

SEQ ID NO: 180 - protein, 240 aa, Homo sapiens
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 181 - protein, 239 aa, Mus musculus
MESVVQPSVFVVDGQTDIPFRRLEQNHRRRRCGTVQVSLALVLLLGAGLATQGWFLLRLHQRLGDIVAHLPDGGKGSWEKLIQDQRSHQANPAAHLTGANASLIGIGGPLLWETRLGLAFLRGLTYHDGALVTMEPGYYYVYSKVQLSGVGCPQGLANGLPITHGLYKRTSRYPKELELLVSRRSPCGRANSSRVWWDSSFLGGVVHLEAGEEVVVRVPGNRLVRPRDGTRSYFGAFMV

SEQ ID NO: 182 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 183 - protein, 197 aa, Mus musculus
MEGEGVQPLDENLENGSRPRFKWKKTLRLVVSGIKGAGMLLCFIYVCLQLSSSPAKDPPIQRLRGAVTRCEDGQLFISSYKNEYQTMEVQNNSVVIKCDGLYIIYLKGSFFQEVKIDLHFREDHNPISIPMLNDGRRIVFTVVASLAFKDKVYLTVNAPDTLCEHLQINDGELIVVQLTPGYCAPEGSYHSTVNQVP

SEQ ID NO: 184 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 185 - protein, 249 aa, Mus musculus
MAMAFCPKDQYWDSSRKSCVSCALTCSQRSQRTCTDFCKFINCRKEQGRYYDHLLGACVSCDSTCTQHPQQCAHFCEKRPRSQANLQPELGRPQAGEVEVRSDNSGRHQGSEHGPGLRLSSDQLTLYCTLGVCLCAIFCCFLVALASFLRRRGEPLPSQPAGPRGSQANSPHAHRPVTEACDEVTASPQPVETCSFCFPERSSPTQESAPRSLGIHGFAGTAAPQPCMRATVGGLGVLRASTGDARPAT

SEQ ID NO: 186 - protein, 281 aa, Homo sapiens [sequence omitted]

SEQ ID NO: 187 - protein, 291 aa, Mus musculus
MPSSGALKDLSFSQHFRMMVICIVLLQVLLQAVSVAVTYMYFTNEMKQLQDNYSKIGLACFSKTDEDFWDSTDGEILNRPCLQVKRQLYQLIEEVTLRTFQDTISTVPEKQLSTPPLPRGGRPQKVAAHITGITRRSNSALIPISKDGKTLGQKIESWESSRKGHSFLNHVLFRNGELVIEQEGLYYIYSQTYFRFQEAEDASKMVSKDKVRTKQLVQYIYKYTSYPDPIVLMKSARNSCWSRDAEYGLYSIYQGGLFELKKNDRIFVSVTNEHLMDLDQEASFFGAFLIN

SEQ ID NO: 188 - protein, 249 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 189 - protein, 129 aa, Mus musculus
MASAWPRSLPQILVLGFGLVLMRAAAGEQAPGTSPCSSGSSWSADLDKCMDCASCPARPHSDFCLGCAAAPPAHFRLLWPILGGALSLVLVLALVSSFLVWRRCRRREKFTTPIEETGGEGCPGVALIQ

SEQ ID NO: 190 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 191 - protein, 316 aa, Mus musculus
MRRASRDYGKYLRSSEEMGSGPGVPHEGPLHPAPSAPAPAPPPAASRSMFLALLGLGLGQVVCSIALFLYFRAQMDPNRISEDSTHCFYRILRLHENADLQDSTLESEDTLPDSCRRMKQAFQGAVQKELQHIVGPQRFSGAPAMMEGSWLDVAQRGKPEAQPFAHLTINAASIPSGSHKVTLSSWYHDRGWAKISNMTLSNGKLRVNQDGFYYLYANICFRHHETSGSVPTDYLQLMVYVVKTSIKIPSSHNLMKGGSTKNWSGNSEFHFYSINVGGFFKLRAGEEISIQVSNPSLLDPDQDATYFGAFKVQDID

SEQ ID NO: 192 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 193 - protein, 390 aa, Mus musculus
MPPSGLRLLPLLLPLPWLLVLTPGRPAAGLSTCKTIDMELVKRKRIEAIRGQILSKLRLASPPSQGEVPPGPLPEAVLALYNSTRDRVAGESADPEPEPEADYYAKEVTRVLMVDRNNAIYEKTKDISHSIYMFFNTSDIREAVPEPPLLSRAELRLQRLKSSVEQHVELYQKYSNNSWRYLGNRLLTPTDTPEWLSFDVTGVVRQWLNQGDGIQGFRFSAHCSCDSKDNKLHVEINGISPKRRGDLGTIHDMNRPFLLLMATPLERAQHLHSSRHRRALDTNYCFSSTEKNCCVRQLYIDFRKDLGWKWIHEPKGYHANFCLGPCPYIWSLDTQYSKVLALYNQHNPGASASPCCVPQALEPLPIVYYVGRKPKVEQLSNMIVRSCKCS

SEQ ID NO: 194 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 195 - protein, 414 aa, Mus musculus
MHYCVLSTFLLLHLVPVALSLSTCSTLDMDQFMRKRIEAIRGQILSKLKLTSPPEDYPEPDEVPPEVISIYNSTRDLLQEKASRRAAACERERSDEEYYAKEVYKIDMPSHLPSENAIPPTFYRPYFRIVRFDVSTMEKNASNLVKAEFRVFRLQNPKARVAEQRIELYQILKSKDLTSPTQRYIDSKVVKTRAEGEWLSFDVTDAVQEWLHHKDRNLGFKISLHCPCCTFVPSNNYIIPNKSEELEARFAGIDGTSTYASGDQKTIKSTRKKTSGKTPHLLLMLLPSYRLESQQSSRRKKRALDAAYCFRNVQDNCCLRPLYIDFKRDLGWKWIHEPKGYNANFCAGACPYLWSSDTQHTKVLSLYNTINPEASASPCCVSQDLEPLTILYYIGNTPKIEQLSNMIVKSCKCS

SEQ ID NO: 196 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 197 - protein, 410 aa, Mus musculus
MHLQRALVVLALLNLATISLSLSTCTTLDFGHIKKKRVEAIRGQILSKLRLTSPPEPSVMTHVPYQVLALYNSTRELLEEMHGEREEGCTQETSESEYYAKEIHKFDMIQGLAEHNELAVCPKGITSKVFRFNVSSVEKNGTNLFRAEFRVLRVPNPSSKRTEQRIELFQILRPDEHIAKQRYIGGKNLPTRGTAEWLSFDVTDTVREWLLRRESNLGLEISIHCPCHTFQPNGDILENVHEVMEIKFKGVDNEDDHGRGDLGRLKKQKDHHNPHLILMMIPPHRLDSPGQGSQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 198 - protein, 193 aa, Homo sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 199 - protein, 192 aa, Mus musculus
MGVPERPTLLLLLSLLLIPLGLPVLCAPPRLICDSRVLERYILEAKEAENVTMGCAEGPRLSENITVPDTKVNFYAWKRMEVEEQAIEVWQGLSLLSEAILQAQALLANSSQPPETLQLHIDKAISGLRSLTSLLRVLGAQKELMSPPDTTPPAPLRTLTVDTFCKLFRVYANFLRGKLKLYTGEVCRRGDR

SEQ ID NO: 200 - protein, 353 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 201 - protein, 356 aa, Mus musculus
MELTDLLLAAMLLAVARLTLSSPVAPACDPRLLNKLLRDSHLLHSRLSQCPDVDPLSIPVLLPAVDFSLGEWKTQTEQSKAQDILGAVSLLLEGVMAARGQLEPSCLSSLLGQLSGQVRLLLGALQGLLGTQLPLQGRTTAHKDPNALFLSLQQLLRGKVRFLLLVEGPTLCVRRTLPTTAVPSSTSQLLTLNKFPNRTSGLLETNFSVTARTAGPGLLSRLQGFRVKITPGQLNQTSRSPVQISGYLNRTHGPVNGTHGLFAGTSLQTLEASDISPGAFNKGSLAFNLQGGLPPSPSLAPDGHTPFPPSPALPTTHGSPPQLHPLFPDPSTTMPNSTAPHPVTMYPHPRNLSQET

SEQ ID NO: 202 - protein, 235 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 203 - protein, 232 aa, Mus musculus
MTVLAPAWSPNSSLLLLLLLLSPCLRGTPDCYFSHSPISSNFKVKFRELTDHLLKDYPVTVAVNLQDEKHCKALWSLFLAQRWIEQLKTVAGSKMQTLLEDVNTEIHFVTSCTFQPLPECLRFVQTNISHLLKDTCTQLLALKPCIGKACQNFSRCLEVQCQPDSSTLLPPRSPIALEATELPEPRPRQLLLLLLLLLPLTLVLLAAAWGLRWQRARRRGELHPGVPLPSHP

SEQ ID NO: 204 - protein, 273 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 205 - protein, 273 aa, Mus musculus
MKKTQTWIITCIYLQLLLFNPLVKTKEICGNPVTDNVKDITKLVANLPNDYMITLNYVAGMDVLPSHCWLRDMVIQLSLSLTTLLDKFSNISEGLSNYSIIDKLGKIVDDLVLCMEENAPKNIKESPKRPETRSFTPEEFFSIFNRSIDAFKDFMVASDTSDCVLSSTLGPEKDSRVSVTKPFMLPPVAASSLRNDSSSSNRKAAKAPEDSGLQWTAMALPALISLVIGFAFGALYWKKKQSSLTRAVENIQINEEDNEISMLQQKEREFQEV

SEQ ID NO: 206 - protein, 554 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQESVFHLLVPSVILVLLAVGGLLFYRWRRRSHQEPQRADSPLEQPEGSPLTQDDRQVELPV

SEQ ID NO: 207 - protein, 552 aa, Mus musculus
MTARGAAGRCPSSTWLGSRLLLVCLLMSRSIAKEVSEHCSHMIGNGHLKVLQQLIDSQMETSCQIAFEFVDQEQLDDPVCYLKKAFFLVQDIIDETMRFKDNTPNANATERLQELSNNLNSCFTKDYEEQNKACVRTFHETPLQLLEKIKNFFNETKNLLEKDWNIFTKNCNNSFAKCSSRDVVTKPDCNCLYPKATPSSDPASASPHQPPAPSMAPLAGLAWDDSQRTEGSSLLPSELPLRIEDPGSAKQRPPRSTCQTLESTEQPNHGDRLTEDSQPHPSAGGPVPGVEDILESSLGTNWVLEEASGEASEGFLTQEAKFSPSTPVGGSIQAETDRPRALSASPFPKSTEDQKPVDITDRPLTEVNPMRPIGQTQNNTPEKTDGTSTLREDHQEPGSPHIATPNPQRVSNSATPVAQLLLPKSHSWGIVLPLGELEGKRSTRDRRSPAELEGGSASEGAARPVARFNSIPLTDTGHVEQHEGSSDPQIPESVFHLLVPGIILVLLTVGGLLFYKWKWRSHRDPQTLDSSVGRPEDSSLTQDEDRQVELPV

SEQ ID NO: 208 - protein, 711 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 209 - protein, 1378 aa, Mus musculus
MGLPLPLLQSSLLLMLLLRLSAASTNLNWQCPRIPYAASRDFSVKYVVPSFSAGGRVQATAAYEDSTNSAVFVATRNHLHVLGPDLQFIENLTTGPIGNPGCQTCASCGPGPHGPPKDTDTLVLVMEPGLPALVSCGSTLQGRCFLHELEPRGKALHLAAPACLFSANNNKPEACTDCVASPLGTRVTVVEQGHASYFYVASSLDPELAASFSPRSVSIRRLKSDTSGFQPGFPSLSVLPKYLASYLIKYVYSFHSGDFVYFLTVQPISVTSPPSALHTRLVRLNAVEPEIGDYRELVLDCHFAPKRRRRGAPEGTQPYPVLQAAHSAPVDAKLAVELSISEGQEVLFGVFVTVKDGGSGMGPNSVVCAFPIYHLNILIEEGVEYCCHSSNSSSLLSRGLDFFQTPSFCPNPPGGEASGPSSRCHYFPLMVHASFTRVDLFNGLLGSVKVTALHVTRLGNVTVAHMGTVDGRVLQVEIARSLNYLLYVSNFSLGSSGQPVHRDVSRLGNDLLFASGDQVFKVPIQGPGCRHFLTCWRCLRAQRFMGCGWCGDRCDRQKECPGSWQQDHCPPEISEFYPHSGPLRGTTRLTLCGSNFYLRPDDVVPEGTHQITVGQSPCRLLPKDSSSPRPGSLKEFIQELECELEPLVTQAVGTTNISLVITNMPAGKHFRVEGISVQEGFSFVEPVLTSIKPDFGPRAGGTYLTLEGQSLSVGTSRAVLVNGTQCRLEQVNEEQILCVTPPGAGTARVPLHLQIGGAEVPGSWTFHYKEDPIVLDISPKCGYSGSHIMIHGQHLTSAWHFTLSFHDGQSTVESRCAGQFVEQQQRRCRLPEYVVRNPQGWATGNLSVWGDGAAGFTLPGFRFLPPPSPLRAGLVELKPEEHSVKVEYVGLGAVADCVTVNMTVGGEVCQHELRGDVVICPLPPSLQLGKDGVPLQVCVDGGCHILSQVVRSSPGRASQRILLIALLVLILLVAVLAVALIFNSRRRKKQLGAHSLSPTTLSDINDTASGAPNHEESSESRDGTSVPLLRTESIRLQDLDRMLLAEVKDVLIPHEQVVIHTDQVIGKGHFGVVYHGEYTDGAQNQTHCAIKSLSRITEVQEVEAFLREGLLMRGLHHPNILALIGIMLPPEGLPRVLLPYMRHGDLLHFIRSPQRNPTVKDLVSFGLQVACGMEYLAEQKFVHRDLAARNCMLDESFTVKVADFGLARGVLDKEYYSVRQHRHARLPVKWMALESLQTYRFTTKSDVWSFGVLLWELLTRGAPPYPHIDPFDLSHFLAQGRRLPQPEYCPDSLYHVMLRCWEADPAARPTFRALVLEVKQVVASLLGDHYVQLTAAYVNVGPRAVDDGSVPPEQVQPSPQHCRSTSKPRPLSEPPLPT

SEQ ID NO: 210 - protein, 11 aa, Artificial Sequence
  Linker
GSSGGSGGSGG

SEQ ID NO: 211 - protein, 8 aa, Artificial Sequence
  Linker
GGGSGGGS

SEQ ID NO: 212 - protein, 12 aa, Artificial Sequence
  Linker
GGGSGGGSGGGS

SEQ ID NO: 213 - protein, 15 aa, Artificial Sequence
  Linker
GGGGSGGGGSGGGGS

SEQ ID NO: 214 - protein, 25 aa, Artificial Sequence
  Linker
GGGGSGGGGSGGGGSGGGGSGGGGS

SEQ ID NO: 215 - protein, 10 aa, Artificial Sequence
  Linker
GGGGSGGGGS

SEQ ID NO: 216 - protein, 5 aa, Artificial Sequence
  Linker
GGGGS

SEQ ID NO: 217 - protein, 7 aa, Artificial Sequence
  Linker
GGGGSGS

SEQ ID NO: 218 - protein, 17 aa, Artificial Sequence
  Linker
GGGGSGGGGSGGGGSGS

SEQ ID NO: 219 - protein, 12 aa, Artificial Sequence
  Linker
GGSLDPKGGGGS

SEQ ID NO: 220 - protein, 20 aa, Artificial Sequence
  Linker
PKSCDKTHTCPPCPAPELLG

SEQ ID NO: 221 - protein, 17 aa, Artificial Sequence
  Linker
SKYGPPCPPCPAPEFLG

SEQ ID NO: 222 - protein, 12 aa, Artificial Sequence
  Linker
GKSSGSGSESKS

SEQ ID NO: 223 - protein, 14 aa, Artificial Sequence
  Linker
GSTSGSGKSSEGKG

SEQ ID NO: 224 - protein, 18 aa, Artificial Sequence
  Linker
GSTSGSGKSSEGSGSTKG

SEQ ID NO: 225 - protein, 18 aa, Artificial Sequence
  Linker
GSTSGSGKPGSGEGSTKG

SEQ ID NO: 226 - protein, 16 aa, Artificial Sequence
  Linker
GSTSGSGKPGSSEGST

SEQ ID NO: 227 - protein, 5 aa, Artificial Sequence
  Linker
GSGGS

SEQ ID NO: 228 - protein, 4 aa, Artificial Sequence
  Linker
GGGS

SEQ ID NO: 229 - protein, 4 aa, Artificial Sequence
  Linker
GGSG

SEQ ID NO: 230 - protein, 5 aa, Artificial Sequence
  Linker
GGSGG

SEQ ID NO: 231 - protein, 5 aa, Artificial Sequence
  Linker
GSGSG

SEQ ID NO: 232 - protein, 5 aa, Artificial Sequence
  Linker
GSGGG

SEQ ID NO: 233 - protein, 5 aa, Artificial Sequence
  Linker
GGGSG

SEQ ID NO: 234 - protein, 5 aa, Artificial Sequence
  Linker
GSSSG

SEQ ID NO: 235 - protein, 430 aa, Artificial Sequence
  ProC1023
QSGQTDVDYYREWSWTQVSGSSGGSLSGRSDNIGSGGSCDLPQTHSLGSRRTLMLLAQMRKISLFSCLKDRHDFGFPQEEFGNQFQKAETIPVLHEMIQQIFNLFTTKDSSAAWDEDLLDKFCTELYQQLNDLEACVMQEERVGETPLMNVDSILAVKKYFRRITLYLTEKKYSPCAWEVVRAEIMRSLSLSTNLQERLRRKELSGRSDNICPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 236 - protein, 429 aa, Artificial Sequence
  ProC1549
QSGQTDVDYYREWSWTQVSGSSGGSGGGSGGGSGSGGSCDLPQTHSLGSRRTLMLLAQMRKISLFSCLKDRHDFGFPQEEFGNQFQKAETIPVLHEMIQQIFNLFTTKDSSAAWDEDLLDKFCTELYQQLNDLEACVMQEERVGETPLMNVDSILAVKKYFRRITLYLTEKKYSPCAWEVVRAEIMRSLSLSTNLQERRRKEGGSGGGGSCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 237 - protein, 391 aa, Artificial Sequence
  ProC659 (non-cleavable steric masked IFN-a2b)
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGSGGSCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 238 - protein, 433 aa, Artificial Sequence
  ProC1239 Arm 1
QSGQTDVDYYREWSWTQVSGSSGGSLSGRSDNIGSGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKELSGRSDNICPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLGK

SEQ ID NO: 239 - protein, 225 aa, Artificial Sequence
  ProC1239 Arm 2
SDNICPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSRLTVDKSRWQEGNVFSCSVMHEALHNRFTQKSLSLSLG

SEQ ID NO: 240 - protein, 429 aa, Artificial Sequence
  ProC1301
QSGQTDVDYYREWSWTQVSGSSGGSGGGSGGGSGSGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESRSKEGGSGGGGSCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 241 - protein, 10 aa, Artificial Sequence
  Cleavable moiety
GLSGRSDNHG

SEQ ID NO: 242 - protein, 17 aa, Artificial Sequence
  Signal Sequence
MRAWIFFLLCLAGRALA

SEQ ID NO: 243 - protein, 23 aa, Artificial Sequence
  Signal sequence
MALTFALLVALLVLSCKSSCSVG

SEQ ID NO: 244 - protein, 20 aa, Artificial Sequence
  Signal sequence
METDTLLLWVLLLWVPGSTG

SEQ ID NO: 245 - protein, 8 aa, Artificial Sequence
  Linker
GPQGTAGQ

SEQ ID NO: 246 - protein, 6 aa, Artificial Sequence
  Spacer sequence
QGQSGS

SEQ ID NO: 247 - protein, 5 aa, Artificial Sequence
  Spacer sequence
GQSGS

SEQ ID NO: 248 - protein, 4 aa, Artificial Sequence
  Spacer sequence
QSGS

SEQ ID NO: 249 - protein, 7 aa, Artificial Sequence
  Spacer sequence
QGQSGQG

SEQ ID NO: 250 - protein, 7 aa, Artificial Sequence
  Linker
YGAGLGW

SEQ ID NO: 251 - protein, 6 aa, Artificial Sequence
  Spacer sequence
GQSGQG

SEQ ID NO: 252 - protein, 5 aa, Artificial Sequence
  Spacer sequence
QSGQG

SEQ ID NO: 253 - protein, 4 aa, Artificial Sequence
  Spacer sequence
SGQG

SEQ ID NO: 254 - protein, 6 aa, Artificial Sequence
  Spacer sequence
QGQSGQ

SEQ ID NO: 255 - protein, 5 aa, Artificial Sequence
  Spacer sequence
GQSGQ

SEQ ID NO: 256 - protein, 4 aa, Artificial Sequence
  Spacer sequence
QSGQ

SEQ ID NO: 257 - protein, 5 aa, Artificial Sequence
  Spacer sequence
QGQSG

SEQ ID NO: 258 - protein, 4 aa, Artificial Sequence
  Spacer sequence
QGQS

SEQ ID NO: 259 - protein, 178 aa, Artificial Sequence
  ProC1640
DNIGSGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKELSGRS

SEQ ID NO: 260 - protein, 639 aa, Artificial Sequence
  ProC1822
KNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 261 - protein, 447 aa, Artificial Sequence
  ProC1823
ISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 262 - protein, 640 aa, Artificial Sequence
  ProC1824
KNLKSPQKVEVDVIDDNFILRWNRSEESVGNVTFSFDYQKPEMDNWIKLPGCQNMTSTKCNFSSLKLNIYDEIKLRIRAEKENTSSWCEVDSFTPFRKAQIGPPEVHLEAEDKAIVIYISPPGTEDSVMWALDRSSFTYSLVIWKNSSSVEERIENIYSRHKISKLSPETTYCLKVKAALLTSRKIGVYGPVHCIKTTVENELPPPENIEVIVQNQNYVLKWDYTYANMTFQVQWLHAFLKRKPGNHLYKWKQIPDCENVTTTQCVFPPNTFQKGIYLLRVQASDGNNTSFWSEEIKFDTEIQASLLPPVFNIRSLSDSLHISIGAPKWSENKPVIQDYPLIYEILFWENTSKAERKIIKKKTDVTIPNLKPLTVYCVKARAHSMDEKLNKSSVFSDVVCEETKSGNTSKPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 263 - protein, 447 aa, Artificial Sequence
  ProC1825
ISHDLPDYTSESCTFKISLRNFRSILSWELKNHSIVATHYKLLYTIMSKPEDLKIVKNCANTTRSFCDLTDEWRSTHEAYVTSLEGFSGNTTLFNCSHNFWLDIDMSFEPPEFEIVGFTNHINVIVKFPSIVEEELQFDLSLVIEEQSEGIVKKHKPTIKGNMSGNFTYIIDKLIPNTNYCVSVYFDHNDEQAVIKSPLKCTLLQPGQESESAESAKPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 264 - protein, 8 aa, Artificial Sequence
  Cleavable moiety
AQNLLGMY

SEQ ID NO: 265 - protein, 18 aa, Artificial Sequence
  Cleavable moiety
LSGRSDNHGGAVGLLAPP

SEQ ID NO: 266 - protein, 20 aa, Artificial Sequence
  Cleavable moiety
VHMPLGFLGPGGLSGRSDNH

SEQ ID NO: 267 - protein, 20 aa, Artificial Sequence
  Cleavable moiety
LSGRSDNHGGVHMPLGFLGP

SEQ ID NO: 268 - protein, 22 aa, Artificial Sequence
  Cleavable moiety
LSGRSDNHGGSGGSISSGLLSS

SEQ ID NO: 269 - protein, 22 aa, Artificial Sequence
  Cleavable moiety
ISSGLLSSGGSGGSLSGRSGNH

SEQ ID NO: 270 - protein, 22 aa, Artificial Sequence
  Cleavable moiety
LSGRSDNHGGSGGSQNQALRMA

SEQ ID NO: 271 - protein, 22 aa, Artificial Sequence
  Cleavable moiety
QNQALRMAGGSGGSLSGRSDNH

SEQ ID NO: 272 - protein, 22 aa, Artificial Sequence
  Cleavable moiety
LSGRSGNHGGSGGSQNQALRMA

SEQ ID NO: 273 - protein, 22 aa, Artificial Sequence
  Cleavable moiety
QNQALRMAGGSGGSLSGRSGNH

SEQ ID NO: 274 - protein, 13 aa, Artificial Sequence
  Cleavable moiety
ISSGLLSGRSGNH

SEQ ID NO: 275 - protein, 22 aa, Artificial Sequence
  Cleavable moiety
AVGLLAPPGGTSTSGRSANPRG

SEQ ID NO: 276 - protein, 22 aa, Artificial Sequence
  Cleavable moiety
TSTSGRSANPRGGGAVGLLAPP

SEQ ID NO: 277 - protein, 24 aa, Artificial Sequence
  Cleavable moiety
VHMPLGFLGPGGTSTSGRSANPRG

SEQ ID NO: 278 - protein, 24 aa, Artificial Sequence
  Cleavable moiety
TSTSGRSANPRGGGVHMPLGFLGP

SEQ ID NO: 279 - protein, 22 aa, Artificial Sequence
  Cleavable moiety
LSGRSGNHGGSGGSISSGLLSS

SEQ ID NO: 280 - protein, 8 aa, Artificial Sequence
  Cleavable sequence
PRFKIIGG

SEQ ID NO: 281 - protein, 8 aa, Artificial Sequence
  Cleavable sequence
PRFRIIGG

SEQ ID NO: 282 - protein, 9 aa, Artificial Sequence
  Cleavable sequence
SSRHRRALD

SEQ ID NO: 283 - protein, 14 aa, Artificial Sequence
  Cleavable sequence
RKSSIIIRMRDVVL

SEQ ID NO: 284 - protein, 15 aa, Artificial Sequence
  Cleavable sequence
SSSFDKGKYKKGDDA

SEQ ID NO: 285 - protein, 15 aa, Artificial Sequence
  Cleavable sequence
SSSFDKGKYKRGDDA

SEQ ID NO: 286 - protein, 4 aa, Artificial Sequence
  Cleavable sequence
IEGR

SEQ ID NO: 287 - protein, 4 aa, Artificial Sequence
  Cleavable sequence
IDGR

SEQ ID NO: 288 - protein, 7 aa, Artificial Sequence
  Cleavable sequence
GGSIDGR

SEQ ID NO: 289 - protein, 6 aa, Artificial Sequence
  Cleavable sequence
PLGLWA

SEQ ID NO: 290 - protein, 8 aa, Artificial Sequence
  Cleavable sequence
GPQGIAGQ

SEQ ID NO: 291 - protein, 8 aa, Artificial Sequence
  Cleavable sequence
GPQGLLGA

SEQ ID NO: 292 - protein, 5 aa, Artificial Sequence
  Cleavable sequence
GIAGQ

SEQ ID NO: 293 - protein, 8 aa, Artificial Sequence
  Cleavable
GPLGIAGI

SEQ ID NO: 294 - protein, 8 aa, Artificial Sequence
  Cleavable sequence
GPEGLRVG

SEQ ID NO: 295 - protein, 8 aa, Artificial Sequence
  Cleavable sequence
YGAGLGVV

SEQ ID NO: 296 - protein, 8 aa, Artificial Sequence
  Cleavable sequence
AGLGVVER

SEQ ID NO: 297 - protein, 8 aa, Artificial Sequence
  Cleavable sequence
AGLGISST

SEQ ID NO: 298 - protein, 8 aa, Artificial Sequence
  298
EPQALAMS

SEQ ID NO: 299 - protein, 8 aa, Artificial Sequence
  Cleavable sequence
QALAMSAI

SEQ ID NO: 300 - protein, 8 aa, Artificial Sequence
  Cleavable sequence
AAYHLVSQ

SEQ ID NO: 301 - protein, 8 aa, Artificial Sequence
  Cleavable sequence
MDAFLESS

SEQ ID NO: 302 - protein, 8 aa, Artificial Sequence
  Cleavable sequence
ESLPVVAV

SEQ ID NO: 303 - protein, 8 aa, Artificial Sequence
  Cleavable sequence
SAPAVESE

SEQ ID NO: 304 - protein, 8 aa, Artificial Sequence
  Cleavable sequence
DVAQFVLT

SEQ ID NO: 305 - protein, 7 aa, Artificial Sequence
  Cleavable sequence
VAQFVLT

SEQ ID NO: 306 - protein, 8 aa, Artificial Sequence
  Cleavable sequence
VAQFVLTE

SEQ ID NO: 307 - protein, 8 aa, Artificial Sequence
  Cleavable sequence
AQFVLTEG

SEQ ID NO: 308 - protein, 8 aa, Artificial Sequence
  Cleavable sequence
PVQPIGPQ

SEQ ID NO: 309 - protein, 422 aa, Artificial Sequence
  IFN-?2b-1204dL-hIgG4, with signal sequence
METDTLLLWVLLLWVPGSTGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGRSDNIGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 310 - DNA, 1269 bp, Artificial Sequence
  IFN-?-1204dL-hIgG4
atggaaaccgacacactgctgctgtgggtgctgcttttgtgggtgccaggatccacaggctgtgatctgcctcaaacgcattcattggggtccaggcgcacgcttatgttgcttgcacagatgaggagaatatcacttttctcttgcttgaaggaccgccacgattttggctttccgcaggaagagttcggtaaccagttccaaaaggcagagacaatccccgttttgcatgagatgatccaacagatctttaacctgttttcaaccaaggatagcagcgcagcgtgggatgagacactgcttgacaagttttacaccgagctctatcagcaacttaatgatctcgaagcctgcgtaattcaaggagtaggcgttacagagacacctttgatgaaggaggattccatccttgcagtaagaaaatacttccagaggatcaccctctacctcaaagaaaagaaatactccccatgcgcgtgggaagtagtgcgagctgaaataatgcggagcttttctttgtcaactaatctccaagaatctctgagaagcaaggagtcaggtaggtctgataatatcgggggaggttctgaatctaagtacggccctccttgtcctccatgtcctgctccagagtttctcggaggcccctccgtgttcctgtttcctccaaagcctaaggacaccctgatgatcagcagaacccctgaagtgacctgcgtggtggtcgacgtttcacaagaggaccccgaggtgcagttcaattggtacgtggacggcgtggaagtgcacaacgccaagaccaagcctagagaggaacagttcaacagcacctacagagtggtgtccgtgctgaccgtgctgcaccaggattggctgaacggcaaagagtacaagtgcaaggtgtccaacaagggcctgcctagcagcatcgagaaaaccatcagcaaggccaagggccagccaagggaaccccaggtttacacactgccacctagccaagaggaaatgaccaagaaccaggtgtccctgacctgcctggtcaagggcttttacccctccgatatcgccgtggaatgggagagcaatggccagcctgagaacaactacaagaccacacctcctgtgctggacagcgacggctcattcttcctgtacagcagactgaccgtggacaagagcagatggcagcagggcaacgtgttcagctgcagcgtgatgcacgaggccctgcacaaccactacacccagaagtctctgagcctgagctga

SEQ ID NO: 311 - protein, 428 aa, Artificial Sequence
  IFN-?2b-1490DNI-hIgG4, with signal sequence
METDTLLLWVLLLWVPGSTGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEISSGLLSGRSDNIGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 312 - DNA, 1287 bp, Artificial Sequence
  IFN-?2b-1490DNI-hIgG4
atggaaaccgacacactgctgctgtgggtgctgcttttgtgggtgccaggatccacaggctgtgatctgcctcaaacgcattcattggggtccaggcgcacgcttatgttgcttgcacagatgaggagaatatcacttttctcttgcttgaaggaccgccacgattttggctttccgcaggaagagttcggtaaccagttccaaaaggcagagacaatccccgttttgcatgagatgatccaacagatctttaacctgttttcaaccaaggatagcagcgcagcgtgggatgagacactgcttgacaagttttacaccgagctctatcagcaacttaatgatctcgaagcctgcgtaattcaaggagtaggcgttacagagacacctttgatgaaggaggattccatccttgcagtaagaaaatacttccagaggatcaccctctacctcaaagaaaagaaatactccccatgcgcgtgggaagtagtgcgagctgaaataatgcggagcttttctttgtcaactaatctccaagaatctctgagaagcaaggagattagttctggcctgctgtcaggtaggtctgataatatcgggggaggttctgaatctaagtacggccctccttgtcctccatgtcctgctccagagtttctcggaggcccctccgtgttcctgtttcctccaaagcctaaggacaccctgatgatcagcagaacccctgaagtgacctgcgtggtggtcgacgtttcacaagaggaccccgaggtgcagttcaattggtacgtggacggcgtggaagtgcacaacgccaagaccaagcctagagaggaacagttcaacagcacctacagagtggtgtccgtgctgaccgtgctgcaccaggattggctgaacggcaaagagtacaagtgcaaggtgtccaacaagggcctgcctagcagcatcgagaaaaccatcagcaaggccaagggccagccaagggaaccccaggtttacacactgccacctagccaagaggaaatgaccaagaaccaggtgtccctgacctgcctggtcaagggcttttacccctccgatatcgccgtggaatgggagagcaatggccagcctgagaacaactacaagaccacacctcctgtgctggacagcgacggctcattcttcctgtacagcagactgaccgtggacaagagcagatggcagcagggcaacgtgttcagctgcagcgtgatgcacgaggccctgcacaaccactacacccagaagtctctgagcctgagctga

SEQ ID NO: 313 - protein, 230 aa, Artificial Sequence
  ProC1718
ISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKGGGGSHHHHHHHH

SEQ ID NO: 314 - protein, 178 aa, Artificial Sequence; identical to SEQ ID NO: 259
  ProC1976

SEQ ID NO: 315 - protein, 7 aa, Artificial Sequence
  Cleavable moiety
LSGRSNI

SEQ ID NO: 316 - protein, 391 aa, Artificial Sequence
  ProC440
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGRSDNICPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 317 - protein, 7 aa, Artificial Sequence
  Hinge sequence
ESKYGPP

SEQ ID NO: 318 - protein, 221 aa, Artificial Sequence
  human IgG Fc with a knob mutation
CPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSRLTVDKSRWQEGNVFSCSVMHEALHNHYTQKSLSLSLG

SEQ ID NO: 319 - protein, 221 aa, Artificial Sequence
  human IgG Fc with a hole mutation
CPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSRLTVDKSRWQEGNVFSCSVMHEALHNRFTQKSLSLSLG

SEQ ID NO: 320 - protein, 4 aa, Artificial Sequence
  stub moiety
SDNI

SEQ ID NO: 321 - protein, 430 aa, Artificial Sequence
  ProC732
QSGQTDVDYYREWSWTQVSGSSGGSLSGRSDNIGSGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKELSGRSDNICPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 322 - protein, 429 aa, Artificial Sequence
  ProC733
QSGQTDVDYYREWSWTQVSGSSGGSLSGRSDNIGSGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 323 - protein, 15 aa, Artificial Sequence
  IFNa-2b masking peptide
TDVDYYREWSWTQVS

SEQ ID NO: 324 - protein, 6 aa, Artificial Sequence
  Linker
GSSGGS

SEQ ID NO: 325 - protein, 4 aa, Artificial Sequence
  Linker
ESKY

SEQ ID NO: 326 - protein, 407 aa, Artificial Sequence
  ProC286
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLSSGGGGSGRSDNIGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 327 - protein, 4 aa, Artificial Sequence
  Linker
SGGG

SEQ ID NO: 328 - protein, 150 aa, Artificial Sequence
  Truncated IFNa-2b
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRS

SEQ ID NO: 329 - protein, 165 aa, Artificial Sequence
  IFNa-2b L130P mutant
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYPKEKKYSPCAWEVVRAEIMRSFSLSTNLQESLRSKE

SEQ ID NO: 330 - protein, 10 aa, Artificial Sequence
  N-terminal sequence
EPKSCDKTHT

SEQ ID NO: 331 - protein, 15 aa, Artificial Sequence
  Peptide mask
IAYLEYYEHLHMAYG

SEQ ID NO: 332 - protein, 15 aa, Artificial Sequence
  Peptide mask
TDVDYYREWCWTQVS

SEQ ID NO: 333 - protein, 15 aa, Artificial Sequence
  Peptide mask
FPLNTFDLVHELLSR

SEQ ID NO: 334 - protein, 15 aa, Artificial Sequence
  Peptide mask
FLNDIHRFLHWTDLM

SEQ ID NO: 335 - protein, 15 aa, Artificial Sequence
  Peptide mask
PYTFVEQVEYWLHAT

SEQ ID NO: 336 - protein, 15 aa, Artificial Sequence
  Peptide mask
ACVIHFLDRISNILE

SEQ ID NO: 337 - protein, 15 aa, Artificial Sequence
  Peptide mask
FCYIAAFSAMQRQSC

SEQ ID NO: 338 - protein, 15 aa, Artificial Sequence
  Peptide mask
PLYLPEIGWMFGLPT

SEQ ID NO: 339 - protein, 15 aa, Artificial Sequence
  Peptide mask
TVLVIPDLHYLYVDR

SEQ ID NO: 340 - protein, 15 aa, Artificial Sequence
  Peptide mask
FINNVETALDTIYNL

SEQ ID NO: 341 - protein, 15 aa, Artificial Sequence
  Peptide mask
SAKHLHPGRLPPMTK

SEQ ID NO: 342 - protein, 15 aa, Artificial Sequence
  Peptide mask
ATMYAYLERLEAILS

SEQ ID NO: 343 - protein, 15 aa, Artificial Sequence
  Peptide mask
IYPLDALLRHLNSLC

SEQ ID NO: 344 - protein, 15 aa, Artificial Sequence
  Peptide mask
CFPTVVWRELYNLYG

SEQ ID NO: 345 - protein, 15 aa, Artificial Sequence
  Peptide mask
NLDFYLNHLYNTLAG

SEQ ID NO: 346 - protein, 15 aa, Artificial Sequence
  Peptide mask
DFINSMRSHLQSSDQ

SEQ ID NO: 347 - protein, 15 aa, Artificial Sequence
  Peptide mask
EPKCSFCSPLIVPSP

SEQ ID NO: 348 - protein, 15 aa, Artificial Sequence
  Peptide mask
PNCIESFLSSIHDSL

SEQ ID NO: 349 - protein, 15 aa, Artificial Sequence
  Peptide mask
TDNALFLETVQHYLY

SEQ ID NO: 350 - protein, 15 aa, Artificial Sequence
  Peptide mask
CYPSISWLFADAPRN

SEQ ID NO: 351 - protein, 15 aa, Artificial Sequence
  Peptide mask
ELTQLLNALVDVRNC

SEQ ID NO: 352 - protein, 15 aa, Artificial Sequence
  Peptide mask
LLSSFVETMSSILTC

SEQ ID NO: 353 - protein, 15 aa, Artificial Sequence
  Peptide mask
YLLRLPSLEELWGPS

SEQ ID NO: 354 - protein, 15 aa, Artificial Sequence
  Peptide mask
ATCYIINHWVERYII

SEQ ID NO: 355 - protein, 14 aa, Artificial Sequence
  Peptide mask
IAYLEYYEHLHMAY

SEQ ID NO: 356 - protein, 20 aa, Artificial Sequence
  Peptide mask
RVTCDDYYYGFGCNKFGRPA

SEQ ID NO: 357 - protein, 429 aa, Artificial Sequence
  Peptide mask
MLAVVGAAALVLVAGAPWVLPSAAGGENLKPPENIDVYIIDDNYTLKWSSHGESMGSVTFSAEYRTKDEAKWLKVPECQHTTTTKCEFSLLDTNVYIKTQFRVRAEEGNSTSSWNEVDPFIPFYTAHMSPPEVRLEAEDKAILVHISPPGQDGNMWALEKPSFSYTIRIWQKSSSDKKTINSTYYVEKIPELLPETTYCLEVKAIHPSLKKHSNYSTVQCISTTVANKMPVPGNLQVDAQGKSYVLKWDYIASADVLFRAQWLPGYSKSSSGSRSDKWKPIPTCANVQTTHCVFSQDTVYTGTFFLHVQASEGNHTSFWSEEKFIDSQKHILPPPPVITVTAMSDTLLVYVNCQDSTCDGLNYEIIFWENTSNTKISMEKDGPEFTLKNLQPLTVYCVQARVLFRALLNKTSNFSEKLCEKTRPGSFST

SEQ ID NO: 358 - protein, 243 aa, Artificial Sequence
  Peptide mask
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAK

SEQ ID NO: 359 - protein, 436 aa, Artificial Sequence
  Peptide mask
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSK

SEQ ID NO: 360 - protein, 242 aa, Artificial Sequence
  Peptide mask
MRSRCTVSAVGLLSLCLVVSASLETITPSAFDGYPDEPCTINITIRNSRLILSWELENKSGPPANYTLWYTVMSKDENLTKVKNCSDTTKSSCDVTDKWLEGMESYVVAIVIVHRGDLTVCRCSDYIVPANAPLEPPEFEIVGFTDHINVTMEFPPVTSKIIQEKMKTTPFVIKEQIGDSVRKKHEPKVNNVTGNFTFVLRDLLPKTNYCVSLYFDDDPAIKSPLKCIVLQPGQESGLSESA

SEQ ID NO: 361 - protein, 17 aa, Artificial Sequence
  Peptide mask
  misc_feature (10)..(17): X may be any amino acid
TDVDYYREWXXXXXXXX

SEQ ID NO: 362 - protein, 17 aa, Artificial Sequence
  Peptide mask
GSGTDVDYYREWSWTQV

SEQ ID NO: 363 - protein, 18 aa, Artificial Sequence
  Peptide mask
GSGTDVDYYREWSWTQVS

SEQ ID NO: 364 - protein, 14 aa, Artificial Sequence
  Peptide mask
TDVDYYREWSWTQV

SEQ ID NO: 365 - protein, 12 aa, Artificial Sequence
  N-terminal sequence
ELKTPLGDTTHT

SEQ ID NO: 366 - protein, 229 aa, Artificial Sequence
  Peptide mask
ALTSTEDPEPPSVPVPTNVLIKSYNLNPVVCWEYQNMSQTPIFTVQVKVYSGSWTDSCTNISDHCCNIYEQIMYPDVSAWARVKAKVGQKESDYARSKEFLMCLKGKVGPPGLEIRRKKEEQLSVLVFHPEVVVNGESQGTMFGDGSTCYTFDYTVYVEHNRSGEILHTKHTVEKEECNETLCELNISVSTLDSRYCLSVDGISSFWQVRTEKSKDVCIPPFHDDRKDS

SEQ ID NO: 367 - protein, 313 aa, Artificial Sequence
  Peptide mask
ASSPDSFSQLAAPLNPRLHLYNDEQILTWEPSPSSNDPRPVVYQVEYSFIDGSWHRLLEPNCTDITETKCDLTGGGRLKLFPHPFTVFLRVRAKRGNLTSKWVGLEPFQHYENVTVGPPKNISVTPGKGSLVIHFSPPFDVFHGATFQYLVHYWEKSETQQEQVEGPFKSNSIVLGNLKPYRVYCLQTEAQLILKNKKIRPHGLLSNVSCHETTANASARLQQVILIPLGIFALLLGLTGACFTLFLKYQSRVKYWFQAPPNIPEQIEEYLKDPDQFILEVLDKDGSPKEDSWDSVSIISSPEKERDDVLQTP

SEQ ID NO: 368 - protein, 228 aa, Artificial Sequence [sequence omitted]

SEQ ID NO: 369 - protein, 220 aa, Artificial Sequence
  Peptide mask
SQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQ

SEQ ID NO: 370 - protein, 639 aa, Artificial Sequence
  IL-12
CRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 371 - protein, 839 aa, Artificial Sequence
  Peptide mask
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 372 - protein, 851 aa, Artificial Sequence
  Peptide mask
NIDVCKLGTVTVQPAPVIPLGSAANISCSLNPKQGCSHYPSSNELILLKFVNDVLVENLHGKKVHDHTGHSSTFQVTNLSLGMTLFVCKLNCSNSQKKPPVPVCGVEISVGVAPEPPQNISCVQEGENGTVACSWNSGKVTYLKTNYTLQLSGPNNLTCQKQCFSDNRQNCNRLDLGINLSPDLAESRFIVRVTAINDLGNSSSLPHTFTFLDIVIPLPPWDIRINFLNASGSRGTLQWEDEGQVVLNQLRYQPLNSTSWNMVNATNAKGKYDLRDLRPFTEYEFQISSKLHLSGGSWSNWSESLRTRTPEEEPVGILDIWYMKQDIDYDRQQISLFWKSLNPSEARGKILHYQVTLQEVTKKTTLQNTTRHTSWTRVIPRTGAWTASVSAANSKGASAPTHINIVDLCGTGLLAPHQVSAKSENMDNILVTWQPPKKADSAVREYIVEWRALQPGSITKFPPHWLRIPPDNMSALISENIKPYICYEIRVHALSESQGGCSSIRGDSKHKAPVSGPHITAITEKKERLFISWTHIPFPEQRGCILHYRIYWKERDSTAQPELCEIQYRRSQNSHPISSLQPRVTYVLWMTAVTAAGESPQGNEREFCPQGKANWKAFVISSICIAIITVGTFSIRYFRQKAFTLLSTLKPQWYSRTIPDPANSTWVKKYPILEEKIQLPTDNLLMAWPTPEEPEPLIIHEVLYHMIPVVRQPYYFKRGQGFQGYSTSKQDAMYIANPQATGTLTAETRQLVNLYKVLESRDPDSKLANLTSPLTVTPVNYLPSHEGYLPSNIEDLSPHEADPTDSFDLEHQHISLSIFASSSLRPLIFGGERLTLDRLKMGYDSLMSNEA

SEQ ID NO: 373 - protein, 248 aa, Artificial Sequence
  Peptide mask
QLGASGPGDGCCVEKTSFPEGASGSPLGPRNLSCYRVSKTDYECSWQYDGPEDNVSHVLWCCFVPPNHTHTGQERCRYFSSGPDRTVQFWEQDGIPVLSKVNFWVESRLGNRTMKSQKISQYLYNWTKTTPPLGHIKVSQSHRQLRMDWNVSEEAGAEVQFRRRMPTTNWTLGDCGPQVNSGSGVLGDIRGSMSESCLCPSENMAQEIQIRRRRRLSSGAPGGPWSDWSMPVCVPPEVLPQALVPRGS

SEQ ID NO: 374 - protein, 719 aa, Artificial Sequence
  Peptide mask
QLGASGPGDGCCVEKTSFPEGASGSPLGPRNLSCYRVSKTDYECSWQYDGPEDNVSHVLWCCFVPPNHTHTGQERCRYFSSGPDRTVQFWEQDGIPVLSKVNFWVESRLGNRTMKSQKISQYLYNWTKTTPPLGHIKVSQSHRQLRMDWNVSEEAGAEVQFRRRMPTTNWTLGDCGPQVNSGSGVLGDIRGSMSESCLCPSENMAQEIQIRRRRRLSSGAPGGPWSDWSMPVCVPPEVLPQAKIKFLVEPLNQGGRRRLTMQGQSPQLAVPEGCRGRPGAQVKKHLVLVRMLSCRCQAQTSKTVPLGKKLNLSGATYDLNVLAKTRFGRSTIQKWHLPAQELTETRALNVSVGGNMTSMQWAAQAPGTTYCLEWQPWFQHRNHTHCTLIVPEEEDPAKMVTHSWSSKPTLEQEECYRITVFASKNPKNPMLWATVLSSYYFGGNASRAGTPRHVSVRNQTGDSVSVEWTASQLSTCPGVLTQYVVRCEAEDGAWESEWLVPPTKTQVTLDGLRSRVMYKVQVRADTARLPGAWSHPQRFSFEVQISRLSIIFASLGSFASVLLVGSLGYIGLNRAAWHLCPPLPTPCGSTAVEFPGSQGKQAWQWCNPEDFPEVLYPRDALVVEMPGDRGDGTESPQAAPECALDTRRPLETQRQRQVQALSEARRLGLAREDCPRGDLAHVTLPLLLGGVTQGASVLDDLWRTHKTAEPGPPTLGQEA

SEQ ID NO: 375 - protein, 214 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 376 - protein, 77 aa, Artificial Sequence
  Peptide mask
ITCPPPMSVEHADIWVKSYSLYSRERYICNSGFKRKAGTSSLTECVLNKATNVAHWTTPSLKCIRDPALVHQRPAPP

SEQ ID NO: 377 - protein, 67 aa, Artificial Sequence
  Peptide mask
ITCPPPMSVEHADIWVKSYSLYSRERYICNSGFKRKAGTSSLTECVLNKATNVAHWTTPSLKCIRDP

SEQ ID NO: 378 - protein, 65 aa, Artificial Sequence
  Peptide mask
ITCPPPMSVEHADIWVKSYSLYSRERYICNSGFKRKAGTSSLTECVLNKATNVAHWTTPSLKCIR

SEQ ID NO: 379 - protein, 175 aa, Artificial Sequence
  Peptide mask
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 380 - protein, 102 aa, Artificial Sequence
  Peptide mask
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAAS

SEQ ID NO: 381 - protein, 78 aa, Artificial Sequence
  Peptide mask
ITCPPPMSVEHADIWVKSYSLYSRERYICNSGFKRKAGTSSLTECVLNKATNVAHWTTPSLKCIRDPALVHQRPAPPS

SEQ ID NO: 382 - protein, 267 aa, Artificial Sequence
  Peptide mask
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 383 - protein, 214 aa, Artificial Sequence
  Peptide mask
AVKNCSHLECFYNSRANVSCMWSHEEALNVTTCHVHAKSNLRHWNKTCELTLVRQASWACNLILGSFPESQSLTSVDLLDINVVCWEEKGWRRVKTCDFHPFDNLRLVAPHSLQVLHIDTQRCNISWKVSQVSHYIEPYLEFEARRRLLGHSWEDASVLSLKQRQQWLFLEMLIPSTSYEVQVRVKAQRNNTGTWSPWSQPLTFRTRPADPMKE

SEQ ID NO: 384 - protein, 214 aa, Artificial Sequence; identical to SEQ ID NO: 375
  Peptide mask

SEQ ID NO: 385 - protein, 188 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 386 - protein, 98 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDF

SEQ ID NO: 387 - protein, 213 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 388 - protein, 213 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 389 - protein, 213 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFEDHLEFEARTLSPGHTWEEAPLLTLKWKQEWISLATLTPDTQYEFQVRVKPLQGEFTTWSPWSQPLAFRTKPAALGKD

SEQ ID NO: 390 - protein, 12 aa, Artificial Sequence
  Peptide mask
CGGHQYERRGGC

SEQ ID NO: 391 - protein, 12 aa, Artificial Sequence
  Peptide mask
CGGHYFERHGGC

SEQ ID NO: 392 - protein, 10 aa, Artificial Sequence
  Peptide mask
CQKLTTVDIC

SEQ ID NO: 393 - protein, 12 aa, Artificial Sequence
  Peptide mask
CSFHQYERHEGC

SEQ ID NO: 394 - protein, 12 aa, Artificial Sequence
  Peptide mask
CSGHQYERREGC

SEQ ID NO: 395 - protein, 12 aa, Artificial Sequence
  Peptide mask
CSGHYFERHEGC

SEQ ID NO: 396 - protein, 8 aa, Artificial Sequence
  Peptide mask
CSHYFERC

SEQ ID NO: 397 - protein, 114 aa, Artificial Sequence
  Peptide mask
DIVMTQSPLSLPVTPGEPASISCRSSQSLLHSNGYNYLDWYLQKPGQSPQLLIYLGSNRASGVPDRFSGSGSGTDFTLKLISRVEAEDVGVYYCMQALQTPLTFGGGTKVEIKR

SEQ ID NO: 398 - protein, 112 aa, Artificial Sequence
  Peptide mask
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPTFGQGTKVEIKR

SEQ ID NO: 399 - protein, 112 aa, Artificial Sequence
  Peptide mask
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQTSQFPTFGQGTKVEIKR

SEQ ID NO: 400 - protein, 112 aa, Artificial Sequence
  Peptide mask
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQTTQFPTFGQGTKVEIKR

SEQ ID NO: 401 - protein, 112 aa, Artificial Sequence
  Peptide mask
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQVTQFPTFGQGTKVEIKR

SEQ ID NO: 402 - protein, 109 aa, Artificial Sequence
  Peptide mask
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKR

SEQ ID NO: 403 - protein, 219 aa, Artificial Sequence
  Peptide mask
ELCDDDPPEIPHATFKAMAYKEGTILNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 404 - protein, 192 aa, Artificial Sequence
  Peptide mask
ELCDDDPPEIPHATFKAMAYKEGTILNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 405 - protein, 178 aa, Artificial Sequence
  Peptide mask
ELCDDDPPEIPHATFKAMAYKEGTILNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKP

SEQ ID NO: 406 - protein, 219 aa, Artificial Sequence
  Peptide mask
ELCDDDPPEIPHATFKAMAYKEGTILNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 407 - protein, 192 aa, Artificial Sequence
  Peptide mask
ELCDDDPPEIPHATFKAMAYKEGTILNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 408 - protein, 178 aa, Artificial Sequence
  Peptide mask
ELCDDDPPEIPHATFKAMAYKEGTILNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKP

SEQ ID NO: 409 - protein, 218 aa, Artificial Sequence
  Peptide mask
ELCDDDPPEIPHATFKAMAYKEGTMLNCECKRGFRRIKELVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 410 - protein, 191 aa, Artificial Sequence
  Peptide mask
ELCDDDPPEIPHATFKAMAYKEGTMLNCECKRGFRRIKELVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 411 - protein, 177 aa, Artificial Sequence
  Peptide mask
ELCDDDPPEIPHATFKAMAYKEGTMLNCECKRGFRRIKELVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKP

SEQ ID NO: 412 - protein, 63 aa, Artificial Sequence
  Peptide mask
ELCDDDPPEIPHATFKAMAYKEGTMLNCECKRGFRRIKSGSLYMLCTGNSSHSSWDNQCQCTS

SEQ ID NO: 413 - protein, 166 aa, Artificial Sequence
  Peptide mask
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGE

SEQ ID NO: 414 - protein, 219 aa, Artificial Sequence
  Peptide mask
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 415 - protein, 192 aa, Artificial Sequence
  Peptide mask
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 416 - protein, 178 aa, Artificial Sequence
  Peptide mask
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKP

SEQ ID NO: 417 - protein, 219 aa, Artificial Sequence; identical to SEQ ID NO: 414
  Peptide mask

SEQ ID NO: 418 - protein, 165 aa, Artificial Sequence
  Peptide mask
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTG

SEQ ID NO: 419 - protein, 164 aa, Artificial Sequence
  Peptide mask
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICT

SEQ ID NO: 420 - protein, 212 aa, Artificial Sequence
  Peptide mask
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETS

SEQ ID NO: 421 - protein, 166 aa, Artificial Sequence
  Peptide mask
ELCDDDPPEIPHATFKAMAYKEGTMLNCECKRGFRRIKSGSLYMLCTGSSSHSSWDNQCQCTSSATRSTTKQVTPQPEEQKERKTTEMQSPMQPVDQASLPGHCREPPPWENEATERIYHFVVGQMVYYQCVQGYRALHRGPAESVCKMTHGKTRWTQPQLICTGE

SEQ ID NO: 422 - protein, 219 aa, Artificial Sequence
  Peptide mask
ELCDDDPPEIPHATFKAMAYKEGTMLNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 423 - protein, 192 aa, Artificial Sequence
  Peptide mask
ELCDDDPPEIPHATFKAMAYKEGTMLNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 424 - protein, 178 aa, Artificial Sequence
  Peptide mask
ELCDDDPPEIPHATFKAMAYKEGTMLNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKP

SEQ ID NO: 425 - protein, 219 aa, Artificial Sequence
  Peptide mask
ELCLYDPPEIPHATFKAMAYKEGTILNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 426 - protein, 192 aa, Artificial Sequence
  Peptide mask
ELCLYDPPEIPHATFKAMAYKEGTILNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 427 - protein, 219 aa, Artificial Sequence
  Peptide mask
ELCLYDPPEIPHATFKAMAYKEGTILNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 428 - protein, 192 aa, Artificial Sequence
  Peptide mask
ELCLYDPPEIPHATFKAMAYKEGTILNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 429 - protein, 178 aa, Artificial Sequence
  Peptide mask
ELCLYDPPEIPHATFKAMAYKEGTILNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKP

SEQ ID NO: 430 - protein, 219 aa, Artificial Sequence
  Peptide mask
ELCLYDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 431 - protein, 192 aa, Artificial Sequence
  Peptide mask
ELCLYDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 432 - protein, 178 aa, Artificial Sequence
  Peptide mask
ELCLYDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKP

SEQ ID NO: 433 - protein, 219 aa, Artificial Sequence
  Peptide mask
ELCLYDPPEIPHATFKAMAYKEGTMLNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 434 - protein, 192 aa, Artificial Sequence
  Peptide mask
ELCLYDPPEIPHATFKAMAYKEGTMLNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSC

SEQ ID NO: 435 - protein, 178 aa, Artificial Sequence
  IL-2
ELCLYDPPEIPHATFKAMAYKEGTMLNCECKRGFRRIKSGSVYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKP

SEQ ID NO: 436 - protein, 58 aa, Artificial Sequence
  Peptide mask
ELCLYDPPEVPNATFKALSYKNGTILNCECKRGFRRLKELVYMRCLGNSWSSNCQCTS

SEQ ID NO: 437 - protein, 215 aa, Artificial Sequence
  Peptide mask
ELCLYDPPEVPNATFKALSYKNGTILNCECKRGFRRLKELVYMRCLGNSWSSNCQCTSNSHDKSRKQVTAQLEHQKEQQTTTDMQKPTQSMHQENLTGHCREPPPWKHEDSKRIYHFVEGQSVHYECIPGYKALQRGPAISICKMKCGKTGWTQPQLTCVDEREHHRFLASEESQGSRNSSPESETSCPITTTDFPQPTETTAMTETFVLTMEYK

SEQ ID NO: 438 - protein, 215 aa, Artificial Sequence; identical to SEQ ID NO: 437
  Peptide mask

SEQ ID NO: 439 - protein, 214 aa, Artificial Sequence
  Peptide mask
ELCLYDPPEVPNATFKALSYKNGTILNCECKRGFRRLKELVYMRCLGNSWSSNCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 440 - protein, 118 aa, Artificial Sequence
  Peptide mask
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQQVAGMLDYWGQGTTVTVSS

SEQ ID NO: 441 - protein, 201 aa, Artificial Sequence
  Peptide mask
GMLSLAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQAFRTLTGH

SEQ ID NO: 442 - protein, 171 aa, Artificial Sequence
  Peptide mask
GMLSLELCDDDPPEIPHATFKAMAYKEGTMLNCECKRGFRRIKSGSLYMLCTGSSSHSSWDNQCQCTSSATRSTTKQVTPQPEEQKERKTTEMQSPMQPVDQASLPGHCREPPPWENEATERIYHFVVGQMVYYQCVQGYRALHRGPAESVCKMTHGKTRWTQPQLICTGE

SEQ ID NO: 443 - protein, 173 aa, Artificial Sequence
  Peptide mask
GMLSLELCDDDPPEIPHATFKAMAYKEGTMLNCECKRGFRRIKSGSLYMLCTGSSSHSSWDNQCQCTSSATRSTTKQVTPQPEEQKERKTTEMQSPMQPVDQASLPGHCREPPPWENEATERIYHFVVGQMVYYQCVQGYRALHRGPAESVCKMTHGKTRWTQPQLICTGEAS

SEQ ID NO: 444 - protein, 183 aa, Artificial Sequence
  Peptide mask
GMLSLELCDDDPPEIPHATFKAMAYKEGTMLNCECKRGFRRIKSGSLYMLCTGSSSHSSWDNQCQCTSSATRSTTKQVTPQPEEQKERKTTEMQSPMQPVDQASLPGHCREPPPWENEATERIYHFVVGQMVYYQCVQGYRALHRGPAESVCKMTHGKTRWTQPQLICTGEASGGGGHHHHHH

SEQ ID NO: 445 - protein, 173 aa, Artificial Sequence; identical to SEQ ID NO: 443
  Peptide mask

SEQ ID NO: 446 - protein, 183 aa, Artificial Sequence; identical to SEQ ID NO: 444
  Peptide mask

SEQ ID NO: 447 - protein, 241 aa, Artificial Sequence
  Peptide mask
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAV

SEQ ID NO: 448 - protein, 272 aa, Artificial Sequence
  Peptide mask
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 449 - protein, 170 aa, Artificial Sequence
  Peptide mask
MLSLELCDDDPPEIPHATFKAMAYKEGTMLNCECKRGFRRIKSGSLYMLCTGSSSHSSWDNQCQCTSSATRSTTKQVTPQPEEQKERKTTEMQSPMQPVDQASLPGHCREPPPWENEATERIYHFVVGQMVYYQCVQGYRALHRGPAESVCKMTHGKTRWTQPQLICTGE

SEQ ID NO: 450 - protein, 8 aa, Artificial Sequence
  Peptide mask
QKLTTVDI

SEQ ID NO: 451 - protein, 122 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCAREDWLGEADYGMDVWGQGTTVTVSS

SEQ ID NO: 452 - protein, 119 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDGEQWRGFDYWGQGTTVTVSS

SEQ ID NO: 453 - protein, 120 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDQEQWRLAFDYWGQGTTVTVSS

SEQ ID NO: 454 - protein, 126 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARGAVAGTGRDYYYYGMDVWGQGTTVTVSS

SEQ ID NO: 455 - protein, 126 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARGSYYDSSGYYYGEDFDYWGQGTTVTVSS

SEQ ID NO: 456 - protein, 121 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCAREEWELEDYGMDVWGQGTTVTVSS

SEQ ID NO: 457 - protein, 119 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDNWGSDAFDIWGQGTTVTVSS

SEQ ID NO: 458 - protein, 122 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDDWFGEADYGMDVWGQGTTVTVSS

SEQ ID NO: 459 - protein, 118 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARRISITPFDYWGQGTTVTVSS

SEQ ID NO: 460 - protein, 120 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDDFWSDYPFDYWGQGTTVTVSS

SEQ ID NO: 461 - protein, 122 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCAREEWFGEADYGMDVWGQGTTVTVSS

SEQ ID NO: 462 - protein, 126 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARGSYYDSSGYYFGEDFDYWGQGTTVTVSS

SEQ ID NO: 463 - protein, 126 aa, Artificial Sequence
  Peptide mask
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARGTVAGTGRDYYYYGMDVWGQGTTVTVSS

SEQ ID NO: 464 - protein, 120 aa, Artificial Sequence
  Peptide mask
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREDFDSHYGMDVWGQGTTVTVSS

SEQ ID NO: 465 - protein, 6 aa, Artificial Sequence
  Peptide mask
SHYFER

SEQ ID NO: 466 - protein, 197 aa, Artificial Sequence
  Peptide mask
TLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNT

SEQ ID NO: 467 - protein, 100 aa, Artificial Sequence
  Peptide mask
TLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVI

SEQ ID NO: 468 - protein, 241 aa, Artificial Sequence
  Peptide mask
WSSKVLMSSANEDIKADLILTSTAPEHLSAPTLPLPEVQCFVFNIEYMNCTWNSSSEPQATNLTLHYRYKVSDNNTFQECSHYLFSKEITSGCQIQKEDIQLYQTFVVQLQDPQKPQRRAVQKLNLQNLVIPRAPENLTLSNLSESQLELRWKSRHIKERCLQYLVQYRSNRDRSWTELIVNHEPRFSLPSVDELKRYTFRVRSRYNPICGSSQQWSKWSQPVHWGSHTVEENPSLFALEA

SEQ ID NO: 469 - protein, 500 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTGGGGSGGGGSGGGGSISSGLLSSGGSGGSLSGRSDNHGGGGSGGGGSLNTTILTPNGNEDTTADFFLTTMPTDSLSVSTLPLPEVQCFVFNVEYMNCTWNSSSEPQPTNLTLHYWYKNSDNDKVKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 470 - protein, 475 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTGGGGSGGGGSGGGGSISSGLLSSGGSGGSLSGRSDNHGGGGSGGGGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 471 - protein, 214 aa, Artificial Sequence
  Peptide mask
AVNGTSQFTCFYNSRANISCVWSQDGALQDTSCQVHAWPDRRRWNQTCELLPVSQASWACNLILGAPESQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 472 - protein, 214 aa, Artificial Sequence
  Peptide mask
AVNGTSQFTCFYNSRANISCVWSQDGALQDTSCQVHAWPDRRRWNQTCELLPVSQASWACNLILGAPDHQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 473 - protein, 214 aa, Artificial Sequence
  Peptide mask
AVNGTSQFTCFYNSRANISCVWSQDGALQDTSCQVHAWPDRRRWNQTCELLPVSQASWACNLILGAPDSQKLTTQDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 474 - protein, 214 aa, Artificial Sequence
  Peptide mask
AVNGTSQFTCFYNSRANISCVWSQDGALQDTSCQVHAWPDRRRWNQTCELLPVSQASWACNLILGAPDSQKLTTFDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 475 - protein, 214 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFQRHLEFEARTLSPGHTWEEAPLLTLKQKQEWICLETLTPDTQYEFQVRVKPLQGEFTTWSPWSQPLAFRTKPAALGKDT

SEQ ID NO: 476 - protein, 214 aa, Artificial Sequence
  Peptide mask
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFQRRLEFEARTLSPGHTWEEAPLLTLKQKQEWICLETLTPDTQYEFQVRVKPLQGEFTTWSPWSQPLAFRTKPAALGKDT

SEQ ID NO: 477 - protein, 214 aa, Artificial Sequence
  Peptide mask
AVNGTSQFTCFYNSYANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 478 - protein, 240 aa, Artificial Sequence
  Peptide mask
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 479 - protein, 213 aa, Artificial Sequence
  Peptide mask
CPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKE

SEQ ID NO: 480 - protein, 392 aa, Artificial Sequence
  ProC859
CDLPQTHSLGSRRTLMLLAQMRKISLFSCLKDRHDFGFPQEEFGNQFQKAETIPVLHEMIQQIFNLFTTKDSSAAWDEDLLDKFCTELYQQLNDLEACVMQEERVGETPLMNVDSILAVKKYFRRITLYLTEKKYSPCAWEVVRAEIMRSLSLSTNLQERLRRKELSGRSDNICPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 481 - protein, 165 aa, Artificial Sequence
  Universal IFN-alpha A/D
CDLPQTHSLGSRRTLMLLAQMRKISLFSCLKDRHDFGFPQEEFGNQFQKAETIPVLHEMIQQIFNLFTTKDSSAAWDEDLLDKFCTELYQQLNDLEACVMQEERVGETPLMNVDSILAVKKYFRRITLYLTEKKYSPCAWEVVRAEIMRSLSLSTNLQERLRRKE

SEQ ID NO: 482 - protein, 166 aa, Homo sapiens; identical to SEQ ID NO: 106

SEQ ID NO: 483 - protein, 203 aa, Gallus gallus
MTANHQSPGMHSILLLLLLPALTTTFSCNHLRHQDANFSWKSLQLLQNTAPPPPQPCPQQDVTFPFPETLLKSKDKKQAAITTLRILQHLFNMLSSPHTPKHWIDRTRHSLLNQIQHYIHHLEQCFVNQGTRSQRRGPRNAHLSINKYFRSIHNFLQHNNYSACTWDHVRLQARDCFRHVDTLIQWMKSRAPLTASSKRLNTQ

SEQ ID NO: 484 - protein, 187 aa, Canis familiaris
MALPCSFSVALVLLSCHSLCCLACHLPDTHSLRNWRVLTLLGQMRRLSASSCDHYTTDFAFPKELFDGQRLQEAQALSVVHVMTQKVFHLFCTNTSSAPWNMTLLEELCSGLSEQLDDLDACPLQEAGLAETPLMHEDSTLRTYFQRISLYLQDRNHSPCAWEMVRAEIGRSFFSLTILQERVRRRK

SEQ ID NO: 485 - protein, 191 aa, Anas platyrhynchos
MPGPSAPPPPAIYSALALLLLLTPPANAFSCSPLRLHDSAFAWDSLQLLRNMAPSPTQPCPQQHAPCSFPDTLLDTNDTQQAAHTALHLLQHLFDTLSSPSTPAHWLHTARHDLLNQLQHHIHHLERCFPADAARLHRRGPRNLHLSINKYFGCIQHFLQNHTYSPCAWDHVRLEAHACFQRIHRLTRTMR

SEQ ID NO: 486 - protein, 189 aa, Bos taurus
MAPAWSFLLALLLLSCNAICSLGCHLPHTHSLPNRRVLTLLRQLRRVSPSSCLQDRNDFAFPQEALGGSQLQKAQAISVLHEVTQHTFQLFSTEGSAAAWDESLLDKLRAALDQQLTDLQACLRQEEGLRGAPLLKEDASLAVRKYFHRLTLYLREKRHNPCAWEVVRAEVMRAFSSSTNLQERFRRKD

SEQ ID NO: 487 - protein, 193 aa, Gallus gallus
MAVPASPQHPRGYGILLLTLLLKALATTASACNHLRPQDATFSHDSLQLLRDMAPTLPQLCPQHNASCSFNDTILDTSNTRQADKTTHDILQHLFKILSSPSTPAHWNDSQRQSLLNRIHRYTQHLEQCLDSSDTRSRTRWPRNLHLTIKKHFSCLHTFLQDNDYSACAWEHVRLQARAWFLHIHNLTGNTRT

SEQ ID NO: 488 - protein, 194 aa, Felis catus
MALPSSFLVALVALGCNSVCSLGCDLPQTHGLLNRRALTLLGQMRRLPASSCQKDRNDFAFPQDVFGGDQSHKAQALSVVHVTNQKIFHFFCTEASSSAAWNTTLLEEFCTGLDRQLTRLEACVLQEVEEGEAPLTNEDIHPEDSILRNYFQRLSLYLQEKKYSPCAWEIVRAEIMRSLYYSSTALQKRLRSEK

SEQ ID NO: 489 - protein, 186 aa, Sus scrofa
MANKCILQIALLMCFSTTALSMSYDVLRYQQRSSNLACQKLLGQLPGTPQYCLEDRMNFEVPEEIMQPPQFQKEDAVLIIHEMLQQIFGILRRNFSSTGWNETVIKTILVELDGQMDDLETILEEIMEEENFPRGDMTILHLKKYYLSILQYLKSKEYRSCAWTVVQVEILRNFSFLNRLTDYLRN

SEQ ID NO: 490 - protein, 186 aa, Bos taurus
MTHRCLLQMVLLLCFSTTALSRSYSLLRFQQRRSLALCQKLLRQLPSTPQHCLEARMDFQMPEEMKQAQQFQKEDAILVIYEMLQQIFNILTRDFSSTGWSETIIEDLLEELYEQMNHLEPIQKEIMQKQNSTMGDTTVLHLRKYYFNLVQYLKSKEYNRCAWTVVRVQILRNFSFLTRLTGYLRE

SEQ ID NO: 491 - protein, 165 aa, Artificial Sequence
  A Chain A, INTERFERON-ALPHA 2B 1RH2
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMNEDSILAVRKYFQRITLYLKEKKYSPCAWEVVRAEIMRSFSLSTNLQESLRSKE

SEQ ID NO: 492 - protein, 5 aa, Artificial Sequence
  Linker
SGGGG

SEQ ID NO: 493 - protein, 396 aa, Artificial Sequence
  ProC288
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGGGGSGRSDNICPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 494 - protein, 399 aa, Artificial Sequence
  ProC289
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGGGGSGRSDNIGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 495 - protein, 403 aa, Artificial Sequence
  ProC290
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGGGGSGRSDNIESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 496 - protein, 407 aa, Artificial Sequence
  ProC291
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGGGGSGRSDNIGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 497 - protein, 237 aa, Artificial Sequence
  ProC441
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGRSDNIGPPCPPCPAPEFLGGPSVFLFPPKPKDTLMISRTPEVTCVVVDVSQEDPEVQFNWYVDGVEVHNA

SEQ ID NO: 498 - protein, 398 aa, Artificial Sequence
  ProC442
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGRSDNIESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 499 - protein, 402 aa, Artificial Sequence
  ProC443
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKESGRSDNIGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQQGNVFSCSVMHEALHNHYTQKSLSLS

SEQ ID NO: 500 - protein, 11 aa, Artificial Sequence
  N-terminal sequence
ESKYGPPCPPC

SEQ ID NO: 501 - protein, 8 aa, Artificial Sequence
  Non-cleavable moiety
GGSGGGGS

What is claimed is:

1. An activatable cytokine construct (ACC) that includes a first monomer construct and a second monomer construct, wherein:
   (a) the first monomer construct comprises a first peptide mask (PM1), a first mature cytokine protein (CP1), a first and a third cleavable moieties (CM1 and CM3), and a first dimerization domain (DD1), wherein the CM1 is positioned between the CP1 and the DD1 and the CM3 is positioned between the PM1 and the CP1, wherein the first monomer construct is characterized in that the CP1 and the DD1 are linked by a linking region of no more than 18 amino acids such that the linking region of no more than 18 amino acids includes the CM1; and
   (b) the second monomer construct comprises a second mature cytokine protein (CP2), a second cleavable moiety (CM2), and a second dimerization domain (DD2), wherein the CM2 is positioned between the CP2 and the DD2,
   wherein the DD1 and the DD2 bind to each other thereby forming a dimer of the first monomer construct and the second monomer construct, wherein the second monomer construct is characterized in that the CP2 and the DD2 are linked by a linking region of no more than 18 amino acids such that the linking region of no more than 18 amino acids includes the CM2, wherein CP1 and CP2 are each a mature interferon, and wherein:

the PM1 comprises a sequence selected from the group consisting of SEQ ID NOs: 328, 329, 323, and 331-369, and the CP1 is an interferon;

the PM1 comprises a sequence selected from the group consisting of SEQ ID NOs: 328, 329, 323, and 331-364, and the CP1 is an interferon alpha;

the PM1 comprises a sequence selected from the group consisting of SEQ ID NOs: 331-360, and 362-364, and the CP1 is an interferon beta; or the PM1 comprises a sequence selected from the group consisting of SEQ ID NOs: 331-360, and 366-369, and the CP1 is an interferon gamma.

2. The ACC of claim 1, wherein the second monomer construct further comprises a second peptide mask (PM2) and a fourth cleavable moiety (CM4), wherein the CM4 is positioned between the PM2 and the CP2.

3. The ACC of claim 2, wherein:

the PM2 comprises a sequence selected from the group consisting of SEQ ID NOs: 328, 329, 323, and 331-369, and the CP2 is an interferon;

the PM2 comprises a sequence selected from the group consisting of SEQ ID NOs: 328, 329, 323, and 331-364, and the CP2 is an interferon alpha;

the PM2 comprises a sequence selected from the group consisting of SEQ ID NOs: 331-360, and 362-364, and the CP2 is an interferon beta; or the PM2 comprises a sequence selected from the group consisting of SEQ ID NOs: 331-360, and 366-369, and the CP2 is an interferon gamma.

4. The ACC of claim 3, wherein PM1, PM2, or PM1 and PM2 comprises an amino acid sequence that is at least 90% identical to SEQ ID NO: 323.

5. The ACC of claim 3, wherein PM1, PM2, or PM1 and PM2 comprises an amino acid sequence that is at least 90% identical to SEQ ID NO: 331.

6. The ACC of claim 3, wherein PM1, PM2, or PM1 and PM2 comprises an amino acid sequence that is at least 90% identical to SEQ ID NO: 332.

7. The ACC of claim 2, wherein the CP1 and the CP2 are the same interferon.

8. The ACC of claim 2, wherein the CP1 and/or the CP2 comprises a sequence that is at least 90% identical to SEQ ID NO: 1.

9. The ACC of claim 8, wherein the ACC is characterized by having a reduced level of interferon alpha activity as compared to the interferon alpha activity of PEGylated interferon alpha-2b.

10. The ACC of claim 2, wherein the first monomer construct comprises in a N- to C-terminal direction, the PM1, an optional linker, the CM3, an optional linker, the CP1, the CM1, and the DD1, wherein the CM1 is a peptide of not more than 10 amino acids, wherein the second monomer construct is the same as the first monomer construct, and wherein the first and second monomer constructs are covalently bound to each other via at least two disulfide bonds.

11. The ACC of claim 9, wherein the CP1 and the CM1 directly abut each other and/or wherein the CM1 and the DD1 directly abut each other.

12. The ACC of claim 2, wherein each of the first monomer construct and the second monomer construct has only one peptide mask.

13. The ACC of claim 2, wherein the PM1 is not a receptor for a cytokine, is not a fragment of a receptor for a cytokine, and does not have an amino acid sequence that is at least 85% identical to a receptor for a cytokine, and wherein the PM2 is not a receptor for a cytokine, is not a fragment of a receptor for a cytokine, and does not have an amino acid sequence that is at least 85% identical to a receptor for a cytokine.

14. The ACC of claim 2, wherein the first monomer construct is characterized in that the CP1 and the DD1 are linked by a linking region of no more than 12 amino acids such that the linking region of no more than 12 amino acids includes the CM1, and wherein the second monomer construct is characterized in that the CP2 and the DD2 are linked by a linking region of no more than 12 amino acids such that the linking region of no more than 12 amino acids includes the CM2.

15. An activatable cytokine construct (ACC) that includes a first monomer construct and a second monomer construct, wherein:

(a) the first monomer construct comprises a first peptide mask (PM1), a first mature cytokine protein (CP1), a first and a third cleavable moieties (CM1 and CM3), and a first dimerization domain (DD1), wherein the CM1 is positioned between the CP1 and the DD1 and the CM3 is positioned between the PM1 and the CP1, wherein the first monomer construct is characterized in that the CP1 and the DD1 are linked by a linking region of no more than 18 amino acids such that the linking region of no more than 18 amino acids includes the CM1; and (b) the second monomer construct comprises a second peptide mask (PM2), a second mature cytokine protein (CP2), a second and a fourth cleavable moieties (CM2 and CM4), and a second dimerization domain (DD2), wherein the CM2 is positioned between the CP2 and the DD2 and the CM4 is positioned between the PM2 and the CP2, wherein the DD1 and the DD2 bind to each other thereby forming a dimer of the first monomer construct and the second monomer construct, wherein the second monomer construct is characterized in that the CP2 and the DD2 are linked by a linking region of no more than 18 amino acids such that the linking region of no more than 18 amino acids includes the CM2, wherein CP1 and CP2 are each a mature interferon, and wherein:

the PM1 comprises a sequence selected from the group consisting of SEQ ID NOs: 328, 329, 323, and 331-369, and the CP1 is an interferon;

the PM1 comprises a sequence selected from the group consisting of SEQ ID NOs: 328, 329, 323, and 331-364, and the CP1 is an interferon alpha;

the PM1 comprises a sequence selected from the group consisting of SEQ ID NOs: 331-360, and 362-364, and the CP1 is an interferon beta; or the PM1 comprises a sequence selected from the group consisting of SEQ ID NOs: 331-360, and 366-369, and the CP1 is an interferon gamma;

and wherein:

the PM2 comprises a sequence selected from the group consisting of SEQ ID NOs: 328, 329, 323, and 331-369, and the CP2 is an interferon;

the PM2 comprises a sequence selected from the group consisting of SEQ ID NOs: 328, 329, 323, and 331-364, and the CP2 is an interferon alpha;

the PM2 comprises a sequence selected from the group consisting of SEQ ID NOs: 331-360, and 362-364, and the CP2 is an interferon beta; or the PM2 comprises a sequence selected from the group consisting of SEQ ID NOs: 331-360, and 366-369, and the CP2 is an interferon gamma.

16. An activatable cytokine construct (ACC) comprising a first monomer construct and a second monomer construct, wherein:
   (a) the first monomer construct comprises a first peptide mask (PM1), a first mature cytokine protein (CP1), a first and a third cleavable moieties (CM1 and CM3), and a first dimerization domain (DD1);
   (b) the second monomer construct is a polypeptide comprising a second peptide mask (PM2), a second mature cytokine protein (CP2), a second and a fourth cleavable moieties (CM2 and CM4), and a second dimerization domain (DD2);
   (c) the first monomer construct is a polypeptide comprising, in an N- to C-terminal direction, the PM1, the CM3, the CP1, the CM1, and the DD1, further wherein:

(i) the PM1 comprises a sequence that is at least 85% identical to SEQ ID NO: 323, (ii) the CM1 and the DD1 directly abut each other, (iii) the CM1 comprises a sequence that is at least 85% identical to SEQ ID NO: 41, and (iv) the CP1 comprises a sequence that is at least 85% identical to SEQ ID NO: 1;

(d) further wherein:

(i) the second monomer construct is the same as the first monomer construct, (ii) the DD1 and DD2 are a pair of human IgG4 Fc domains;

(e) the DD1 and the DD2 covalently bind to each other via at least one disulfide bond, thereby forming a homodimer of the first monomer construct and the second monomer construct; and (f) the ACC is characterized by having a reduced level of interferon alpha activity as compared to the interferon alpha activity of PEGylated interferon alpha-2b, and wherein:

the PM2 comprises a sequence selected from the group consisting of SEQ ID NOs: 328, 329, 323, and 331-369, and the CP2 is an interferon;

the PM2 comprises a sequence selected from the group consisting of SEQ ID NOs: 328, 329, 323, and 331-364, and the CP2 is an interferon alpha;

the PM2 comprises a sequence selected from the group consisting of SEQ ID NOs: 331-360, and 362-364, and the CP2 is an interferon beta; or the PM2 comprises a sequence selected from the group consisting of SEQ ID NOs: 331-360, and 366-369, and the CP2 is an interferon gamma.

17. The ACC of claim 16, wherein the PM2 comprises a sequence that is at least 85%, 90%, or 95% identical to one of SEQ ID NOs: 323, 331, or 332.

18. An activatable cytokine construct (ACC) comprising a first monomer construct and a second monomer construct, wherein:

(a) the first monomer construct is a polypeptide comprising a first peptide mask (PM1), a first mature cytokine protein (CP1), a first and a third cleavable moieties (CM1 and CM3), and a first dimerization domain (DD1);

(b) the second monomer construct is a polypeptide comprising a second peptide mask (PM2), a second mature cytokine protein (CP2), a second and a fourth cleavable moieties (CM2 and CM4), and a second dimerization domain (DD2);

(c) the first monomer construct comprises, in an N- to C-terminal direction, the PM1, the CM3, the CP1, the CM1, and the DD1, further wherein:

(i) the PM1 comprises no more than 20 amino acids and binds to the CP1, (ii) the CM1 and the DD1 directly abut each other, (iii) the CP1 and the CM1 directly abut each other, (iv) the CM1 comprises no more than 12 amino acids, (v) the CM1 and the CM3 each functions as a substrate for a protease, and (vi) the CP1 is a mature interferon;

(d) further wherein:

(i) the second monomer construct is the same as the first monomer construct, (ii) the DD1 and the DD2 are a pair of human IgG Fc domains;

(iii) the DD1 and the DD2 bind to each other via at least one disulfide bond, thereby forming a homodimer of the first monomer construct and the second monomer construct; and (e) the ACC is characterized by having a reduced level of interferon activity as compared to a corresponding wildtype interferon or a corresponding pegylated interferon, and wherein:

the PM1 comprises a sequence selected from the group consisting of SEQ ID NOs: 328, 329, 323, and 331-369, and the CP1 is an interferon;

the PM1 comprises a sequence selected from the group consisting of SEQ ID NOs: 328, 329, 323, and 331-364, and the CP1 is an interferon alpha;

the PM1 comprises a sequence selected from the group consisting of SEQ ID NOs: 331-360, and 362-364, and the CP1 is an interferon beta; or the PM1 comprises a sequence selected from the group consisting of SEQ ID NOs: 331-360, and 366-369, and the CP1 is an interferon gamma;

and wherein:

the PM2 comprises a sequence selected from the group consisting of SEQ ID NOs: 328, 329, 323, and 331-369, and the CP2 is an interferon;

the PM2 comprises a sequence selected from the group consisting of SEQ ID NOs: 328, 329, 323, and 331-364, and the CP2 is an interferon alpha;

the PM2 comprises a sequence selected from the group consisting of SEQ ID NOs: 331-360, and 362-364, and the CP2 is an interferon beta; or the PM2 comprises a sequence selected from the group consisting of SEQ ID NOs: 331-360, and 366-369, and the CP2 is an interferon gamma.

19. The ACC of claim 18, wherein the CM1 and the CM3 each independently functions as a substrate of urokinase (uPa) and/or MMP-14.

20. The ACC of claim 18, wherein the CP1 is a mature interferon-alpha and the PM1 comprises a sequence that is at least 85% identical to SEQ ID NO: 323.

21. The ACC of claim 20, wherein the mature interferon alpha is mature interferon alpha-2b.

22. The ACC of claim 20, wherein the mature interferon alpha is a truncated form of a wildtype mature interferon alpha-2b.

23. The ACC of claim 18, wherein the mature interferon comprises a sequence that is at least 95% identical to SEQ ID NO: 1.

24. The ACC of claim 18, wherein the CM1 and the CM3 each comprises no more than 8 amino acids.

25. The ACC of claim 18, wherein the CM1 and the CM3 each comprises a sequence selected from the group consisting of SEQ ID NO: 41, SEQ ID NO: 68, and SEQ ID NO: 100.

26. The ACC of claim 18, wherein the DD1 and the DD2 each comprises the sequence of SEQ ID NO: 3.

27. The ACC of claim 18, wherein the first and second monomer constructs are covalently bound to each other via at least two disulfide bonds, and wherein the ACC exhibits lower toxicity in vivo compared to either wildtype interferon alpha-2b or PEGylated interferon alpha-2b.

28. The ACC of claim 18, wherein the first and second monomer constructs each comprises a sequence that is at least 95% identical to SEQ ID NO: 321.

29. The ACC of claim 18, wherein each of the first monomer construct and the second monomer construct has only one peptide mask.

30. The ACC of claim 15, wherein each of the first and second monomer constructs comprises the sequence of SEQ ID NO: 321.

\* \* \* \* \*